US012077577B2

(12) United States Patent
Kitamura et al.

(10) Patent No.: US 12,077,577 B2
(45) Date of Patent: Sep. 3, 2024

(54) POLYPEPTIDE COMPRISING AGGRECAN BINDING DOMAIN AND CARRYING MOIETY

(71) Applicant: Chugai Seiyaku Kabushiki Kaisha, Tokyo (JP)

(72) Inventors: Hidetomo Kitamura, Gotemba (JP); Maiko Hoshino, Singapore (SG); Yang Sun, Singapore (SG); Taichi Kuramochi, Singapore (SG); Wenjie Tu, Gotemba (JP); Tomoyuki Igawa, Singapore (SG); Naoka Hironiwa, Singapore (SG); Yuki Noguchi, Gotemba (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 132 days.

(21) Appl. No.: 17/058,961

(22) PCT Filed: May 30, 2019

(86) PCT No.: PCT/JP2019/021463
§ 371 (c)(1),
(2) Date: Nov. 25, 2020

(87) PCT Pub. No.: WO2019/230867
PCT Pub. Date: Dec. 5, 2019

(65) Prior Publication Data
US 2021/0221875 A1    Jul. 22, 2021

(30) Foreign Application Priority Data
May 30, 2018   (JP) ................................ 2018-103233

(51) Int. Cl.
    *C07K 16/18*     (2006.01)
    *A61K 39/00*     (2006.01)

(52) U.S. Cl.
    CPC ........ *C07K 16/18* (2013.01); *A61K 2039/505* (2013.01); *C07K 2317/56* (2013.01)

(58) Field of Classification Search
    CPC ................ C07K 16/18; C07K 2317/56; A61K 2039/505
See application file for complete search history.

(56) References Cited

U.S. PATENT DOCUMENTS

| 8,518,404 | B2 | 8/2013 | Daugherty et al. |
| 8,809,504 | B2 | 8/2014 | Lauermann |

(Continued)

FOREIGN PATENT DOCUMENTS

| AU | 2016213702 A1 | 8/2016 |
| CA | 3041279 A1 | 5/2018 |

(Continued)

OTHER PUBLICATIONS

Kussie "A Single Engineered Amino Acid Substitution Changes Antibody Fine Specificity" J immunol 152(1):146-52 (Year: 1994).*

(Continued)

*Primary Examiner* — Aurora M Fontainhas
*Assistant Examiner* — Selam Berhane
(74) *Attorney, Agent, or Firm* — Nixon & Vanderhye P.C.

(57) ABSTRACT

The present invention provides a polypeptide comprising an antigen binding domain which binds to an antigen present in cartilage tissue, and also provides use of the polypeptide. The polypeptide of the invention is useful for penetrating and/or retaining a desired substance in the cartilage tissue for a long period. The present invention further relates to a polypeptide comprising (i) an antigen binding domain which binds to a molecule in a cartilage tissue, and (ii) a carrying moiety having an inhibiting domain that inhibits the antigen binding activity of the antigen binding domain, and having a longer half-life than that of the antigen binding domain (Continued)

existing alone, and a pharmaceutical composition comprising the polypeptide. The present invention further relates to methods for producing and screening for the polypeptide.

27 Claims, 67 Drawing Sheets

Specification includes a Sequence Listing.

(56) References Cited

U.S. PATENT DOCUMENTS

| | | | |
|---|---|---|---|
| 9,737,623 | B2 | 8/2017 | Desnoyers et al. |
| 10,357,571 | B2 | 7/2019 | Williams et al. |
| 11,046,759 | B2 | 6/2021 | Moore et al. |
| 11,168,139 | B2 | 11/2021 | Igawa et al. |
| 2003/0235589 | A1* | 12/2003 | Demopulos ........ A61K 31/4427 530/391.1 |
| 2004/0259768 | A1 | 12/2004 | Lauermann |
| 2007/0099246 | A1* | 5/2007 | Sandy ................. G01N 33/574 435/70.21 |
| 2010/0189651 | A1 | 7/2010 | Stagliano et al. |
| 2011/0064666 | A1 | 3/2011 | Ogawa et al. |
| 2012/0149061 | A1* | 6/2012 | Stagliano ........... A61K 47/6849 435/69.6 |
| 2012/0244154 | A1 | 9/2012 | Daugherty et al. |
| 2015/0157748 | A1 | 6/2015 | Desnoyers et al. |
| 2015/0297741 | A1* | 10/2015 | Robillard .............. A61K 47/60 424/182.1 |
| 2016/0144042 | A1 | 5/2016 | Williams et al. |
| 2016/0194399 | A1 | 7/2016 | Irving et al. |
| 2016/0289324 | A1 | 10/2016 | Moore et al. |
| 2017/0152323 | A1* | 6/2017 | Chang .................... A61P 29/00 |
| 2018/0057593 | A1* | 3/2018 | Dennis ................... A61P 29/00 |
| 2019/0359721 | A1 | 11/2019 | Igawa et al. |
| 2020/0207846 | A1 | 7/2020 | Igawa et al. |
| 2020/0369781 | A1 | 11/2020 | Igawa et al. |
| 2021/0155701 | A1 | 5/2021 | Hoshino et al. |
| 2021/0206845 | A1 | 7/2021 | Igawa et al. |

FOREIGN PATENT DOCUMENTS

| | | |
|---|---|---|
| CN | 101821288 A | 9/2010 |
| CN | 103068847 A | 4/2013 |
| CN | 103958547 A | 7/2014 |
| CN | 104661676 A | 5/2015 |
| CN | 106459153 A | 2/2017 |
| CN | 107602706 A | 1/2018 |
| CN | 103958547 B | 8/2018 |
| CN | 111836828 A | 10/2020 |
| CN | 107602706 B | 12/2020 |
| CN | 114127277 A | 3/2022 |
| EP | 2957633 A1 | 12/2015 |
| EP | 3546480 A1 | 10/2019 |
| EP | 3546574 A1 | 10/2019 |
| EP | 3719036 A1 | 10/2020 |
| EP | 3981428 A1 | 4/2022 |
| JP | 2009512844 A | 3/2009 |
| JP | 2010536370 A | 12/2010 |
| JP | 2011026298 A | 2/2011 |
| JP | 2012504035 A | 2/2012 |
| JP | 2012514982 A | 7/2012 |
| JP | 2013538204 A | 10/2013 |
| JP | 2014509605 A | 4/2014 |
| JP | 2015509952 A | 4/2015 |
| JP | 2015517320 A | 6/2015 |
| JP | 5753903 B2 | 7/2015 |
| JP | 5765894 B2 | 8/2015 |
| JP | 5851842 B2 | 2/2016 |
| JP | 6035009 B2 | 11/2016 |
| JP | 6130307 B2 | 5/2017 |
| JP | 6178846 B2 | 8/2017 |
| JP | 2017523176 A | 8/2017 |
| JP | 2017529853 A | 10/2017 |
| JP | 2017530092 A | 10/2017 |
| JP | 6273215 B2 | 1/2018 |
| JP | 6577016 B2 | 9/2019 |
| JP | 7020909 B2 | 2/2022 |
| RU | 2012110127 A | 9/2013 |
| RU | 2583876 C2 | 5/2016 |
| RU | 2015101803 A | 8/2016 |
| WO | WO-2004021861 A2 | 3/2004 |
| WO | WO-2007027935 A2 | 3/2007 |
| WO | WO2007045661 A1 | 4/2007 |
| WO | WO-2007063308 A2 | 6/2007 |
| WO | WO-2007063311 A2 | 6/2007 |
| WO | WO-2008149149 A2 | 12/2008 |
| WO | WO2008157379 A2 | 12/2008 |
| WO | WO-2009021754 A2 | 2/2009 |
| WO | WO-2009025846 A2 | 2/2009 |
| WO | WO2010039206 A1 | 4/2010 |
| WO | WO-2010081173 A2 | 7/2010 |
| WO | WO-2010115998 A2 | 10/2010 |
| WO | WO-2011020783 A3 | 4/2011 |
| WO | WO-2011123683 A2 | 10/2011 |
| WO | WO-2012025525 A1 | 3/2012 |
| WO | WO-2012123755 A1 | 9/2012 |
| WO | WO2013046704 A2 | 4/2013 |
| WO | WO-2013128194 A1 | 9/2013 |
| WO | WO-2013148248 A1 | 10/2013 |
| WO | WO-2013176730 A1 | 11/2013 |
| WO | WO2013180834 A2 | 12/2013 |
| WO | WO2013192550 A2 | 12/2013 |
| WO | WO-2014052462 A2 | 4/2014 |
| WO | WO-2014125955 A1 | 8/2014 |
| WO | WO2015066279 A2 | 5/2015 |
| WO | WO-2015108998 A2 | 7/2015 |
| WO | WO-2015116933 A2 | 8/2015 |
| WO | WO2016014974 A2 | 1/2016 |
| WO | WO2016016265 A1 | 2/2016 |
| WO | WO-2016016269 A1 | 2/2016 |
| WO | WO-2016046778 A2 | 3/2016 |
| WO | WO-2016118629 A1 | 7/2016 |
| WO | WO-2016179003 A1 | 11/2016 |
| WO | WO-2016182064 A1 | 11/2016 |
| WO | WO-2017025698 A1 | 2/2017 |
| WO | WO-2017162587 A1 | 9/2017 |
| WO | WO2018085555 A1 | 5/2018 |
| WO | WO-2018097307 A1 | 5/2018 |
| WO | WO-2018097308 A1 | 5/2018 |
| WO | WO-2018220225 A1 | 12/2018 |
| WO | WO-2018220236 A1 | 12/2018 |
| WO | WO-2019107380 A1 | 6/2019 |
| WO | WO-2019107384 A1 | 6/2019 |
| WO | WO-2019230866 A1 | 12/2019 |
| WO | WO-2019230868 A1 | 12/2019 |
| WO | WO-2020246567 A1 | 12/2020 |
| WO | WO2021149697 A1 | 7/2021 |
| WO | WO2023002952 A1 | 1/2023 |

OTHER PUBLICATIONS

Morgan "what do anti-collagen antibodies mean?" ann rheumatic dis 49:62-65 (Year: 1990).*
Adkisson "Immune evasion by neocartilage-derived chondrocytes: Implications for biologic repair of joint articular cartilage" stem cell res 4:57-68 (Year: 2010).*
Hybribody "VHH Nanobody Properties" accessed from hybribody.com on Oct. 21, 2022 (Year: 2016).*
Yokota "Rapid Tumor Penetration of a Single-Chain Fv and Comparison with Other Immunoglobulin Forms" cancer research 52:3402-3408 (Year: 1992).*
Fan "Activation of Interleukin-1 Signaling Cascades in Normal and Osteoarthritic Articular Cartilage" amer j path 171(3):938-946 (Year: 2007).*
Grunke "Successful treatment of inflammatory knee osteoarthritis with tumour necrosis factor blockade" ann rheum dis 65:555-556 (Year: 2006).*
Penn "New treatment target discovered that halts osteoarthritis-like knee cartilage degeneration" accessed from pennmedicine.com on Jul. 24, 2023 (Year: 2021).*

(56) References Cited

OTHER PUBLICATIONS

Pratta "Aggrecan Protects Cartilage Collagen from Proteolytic Cleavage" JBC 278(46):45539-45545 (Year: 2003).*
Abstract of ACR/ARHP Annual Meeting, accessed at [https://plan.core-apps.com/tristar_acr17/abstract/7f9a3c05b0ca255af1fc655b034e5eaa], Accessed on Apr. 23, 2018.
Acchione, M., et al., "Impact of linker and conjugation chemistry on antigen binding, Fc receptor binding and thermal stability of model antibody-drug conjugates," mAbs, 3:362-372 (2012).
Alley, S.C., et al., "Antibody-drug Conjugates: Targeted Drug Delivery for Cancer," Current Opinion in Chemical Biology, 14(4):529-537 (2010).
Asano, R. and Kumagai, I., "Functionalization of Bispecific Therapeutic Antibodies Based on Protein Engineering," Yakugaku Zasshi: Journal of the Pharmaceutical Society of Japan, 135(7):851-856 (2015).
Baeuerle, P.A., et al., "BiTE: Teaching Antibodies to Engage T-cells for Cancer Therapy," Current Opinion in Molecular Therapeutics, 11(1):22-30 (2009).
Cohen, S.B., et al., "A Randomized, Double-blind Study of AMG 108 (a Fully Human Monoclonal Antibody to IL-1R1) in Patients With Osteoarthritis of the Knee," Arthritis Research & Therapy, 13(4):R125 (2011).
De Bono, J.S., et al., "ING-1, A Monoclonal Antibody Targeting Ep-CAM in Patients With Advanced Adenocarcinomas," Clinical Cancer Research, 10(22):7555-7565 (2004).
Desjarlais, J.R., et al., "Optimizing Engagement of the Immune System by Anti-Tumor Antibodies: An Engineer's Perspective," Drug Discovery Today, 12(21-22):898-910 (2007).
Desnoyers, L.R., et al., "Tumor-specific Activation of an EGFR-targeting Probody Enhances Therapeutic Index," Science Translational Medicine, 5(207):207ra144 (2013).
Didomenico, C., et al., "Mechanically Aided Transport of Antibodies Through Articular Cartilage," Abstracts/Osteoarthritis and Cartilage, 23:A287-A288 (2015).
Dinarello, C. A., et al., "Treating inflammation by blocking interleukin-1 in a broad spectrum of diseases," Nat Rev Drug Discov., 11(8):633-652 (2012).
Erster, O., et al., "Site-Specific Targeting of Antibody Activity in Vivo Mediated by Disease-Associated Proteases," J Control Release, 161(3):804-812 (2012).
Gerspach, J., et al., "Target-Selective Activation of a TNF Prodrug by Urokinase-Type Plasminogen Activator (uPA) Mediated Proteolytic Processing at the Cell Surface," Cancer Immunology, Immunotherapy, 55(12):1590-1600 (2006).
Gladkov, O., et al., "Cyclophosphamide and Tucotuzumab (huKS-IL2) Following First-line Chemotherapy in Responding Patients With Extensive-disease Small-cell Lung Cancer," Anti-Cancer Drugs, 26(10):1061-1068 (2015).
Halin, C., et al., "Synergistic Therapeutic Effects of a Tumor Targeting Antibody Fragment, Fused to Interleukin 12 and to Tumor Necrosis Factor α," Cancer Res., 63:3202-3210 (2003).
Harmsen, M., et al., "Selection and Optimization of Proteolytically Stable Llama Single-domain Antibody Fragments for Oral Immunotherapy," Applied Microbiology and Biotechnology, 72(3):544-551 (2006).
Hussack, G., et al., "Engineered Single-Domain Antibodies with High Protease Resistance and Thermal Stability," PLoS One, 6(11):e28218 (2011).
Jia, H., et al., "EGFR signaling is critical for maintaining the superficial layer of articular cartilage and preventing osteoarthritis initiation," PNAS, 113(50):14360-14365 (2016).
Juszczak, A., et al., "Ipilimumab: A Novel Immunomodulating Therapy Causing Autoimmune Hypophysitis: A Case Report and Review," European Journal of Endocrinology, 167(1):1-5 (2012).
Kiani, C., et al., "Structure and Function of Aggrecan," Cell Research, 12(1):19-32 (2002).
Kim, S.J., et al., "Antibody Engineering for the Development of Therapeutic Antibodies," Molecules and Cells, 20(1):17-29 (2005).

Kromann-Hansen, T., et al., "A Camelid-derived Antibody Fragment Targeting the Active Site of a Serine Protease Balances Between Inhibitor and Substrate Behavior," The Journal of Biology Chemistry, 291(29):15156-15168 (2016).
Lewis, G.D., et al., "Differential Responses of Human Tumor Cell Lines to Anti-p185HER2 Monoclonal Antibodies," Cancer Immunology, Immunotherapy, 37(4):255-263 (1993).
Lutterbuese, R., et al., "T Cell-Engaging BiTE Antibodies Specific for EGFR Potently Eliminate KRAS- and BRAF-Mutated Colorectal Cancer Cells," Proceedings of the National Academy of Sciences of the United States of America, 107(28):12605-12610 (2010).
Martel-Pelletier, J., et al., "Osteoarthritis," Nature Reviews Disease Primers, 2:16072 (2016).
Muller, S., et al., "Spliceosomal Peptide P140 For Immunotherapy of Systemic Lupus Erythematosus: Results of an Early Phase II Clinical Trial," Arthritis and Rheumatism, 58(12):3873-3883 (2008).
Nam, J.L., et al., "Current Evidence for the Management of Rheumatoid Arthritis With Biological Disease-modifying Antirheumatic Drugs: A Systematic Literature Review Informing the EULAR Recommendations for the Management of RA," Annals of the Rheumatic Diseases, 69(6):976-986 (2010).
Neri, D., et al., "Immunocytokines for cancer treatment: past, present and future," Curr Opin Immunol., 40:96-102 (2016).
Paoloni, M., et al., "Defining the Pharmacodynamic Profile and Therapeutic Index of NHS-IL 12 Immunocytokine in Dogs With Malignant Melanoma," PLoS One, 10(6):e0129954 (2015).
Papadia, F., et al., "Isolated Limb Perfusion With the Tumor-targeting Human Monoclonal Antibody-cytokine Fusion Protein L19-TNF Plus Melphalan and Mild Hyperthermia in Patients With Locally Advanced Extremity Melanoma," Journal of Surgical Oncology, 107(2):173-179 (2013).
Pavlou, A.K. and Belsey, M.J, "The Therapeutic Antibodies Market to 2008," European Journal of Pharmaceutics and Biopharmaceutics, 59(3):389-396 (2005).
Polu, K.R., et al., "Probody Therapeutics for Targeting Antibodies to Diseased Tissue," Expert Opinion on Biological Therapy, 14(8):1049-1053 (2014).
Puskas, J., et al., "Development of an Attenuated Interleukin-2 Fusion Protein That Can Be Activated by Tumour-Expressed Proteases," Immunology, 133(2):206-220 (2011).
R&D Systems., "Human Aggrecan G1-IGD-G2 Domains Antibody," Monoclonal Mouse lgG2B Clone # 179509, Catalog No. MAB1220, 1 Page (2018).
Reichert, J.M., et al., "Monoclonal Antibody Successes in the Clinic," Nature Biotechnology, 23(9):1073-1078 (2005).
Riechelmann, H., et al., "Phase I Trial With the CD44v6-Targeting Immunoconjugate Bivatuzumab Mertansine in Head and Neck Squamous Cell Carcinoma," Oral Oncology, 44(9):823-829 (2008).
Roitt, I., et al., Immunology, M., Mir, 109-111 (2000) (in Russian, with what is believed to be a published English equivalent of those pages taken from Roitt, et al., Immunology, Fifth Ed., 78-81 (1998).
Satoh, M., et al., "Non-Fucosylated Therapeutic Antibodies as Next-Generation Therapeutic Antibodies," Expert Opinion on Biological Therapy, 6(11):1161-1173 (2006).
Severin, Y. S., editor, "Biochemistry, Textbook for Higher Education," Moscow, Geotar-Med, 39-45 (2004).
Swearingen, C. A., et al., "Development of a novel clinical biomarker assay to detect and quantify aggrecanase-generated aggrecan fragments in human synovial fluid, serum and urine," Osteoarthritis Cartilage, 18:1150-1158 (2010).
Takeuchi, T., et al., "The Japanese Experience With Biologic Therapies for Rheumatoid Arthritis," Nature Reviews. Rheumatology, 6(11):644-652 (2010).
Thomas, D.A., et al., "A Broad-spectrum Fluorescence-based Peptide Library for the Rapid Identification of Protease Substrates," Proteomics, 6(7):2112-2120 (2006).
Torres, M. and Casadevall, A., "The immunoglobulin constant region contributes to affinity and specificity," Trends in Immunol., 29(2):91-97 (2008).
Trinh, V.A., et al., "Ipilimumab in the Treatment of Melanoma," Expert Opinion on Biological Therapy, 12(6):773-782 (2012).

(56) References Cited

OTHER PUBLICATIONS

Turk, B.E., et al., "Determination of Protease Cleavage Site Motifs Using Mixture-based Oriented Peptide Libraries," Nature Biotechnology, 19(7):661-667 (2001).

Tzeng, A., et al., "Antigen Specificity Can Be Irrelevant to Immunocytokine Efficacy and Biodistribution," Proceedings of the National Academy of Sciences of the United States of America, 112(11):3320-3325 (2015).

Van Roy, M., et al., "The preclinical pharmacology of the high affinity anti-IL-6R Nanobody® ALX-0061 supports its clinical development in rheumatoid arthritis," Arthitis Res Ther., 17:135 (2015).

Vignali, D.A.A. and Kuchroo, V.K., "IL-12 Family Cytokines: Immunological Playmakers," Nat Immunol., 13(8):722-728 (2012).

Weiner, L.M., et al., "Monoclonal Antibodies: Versatile Platforms for Cancer Immunotherapy," Nature Reviews. Immunology, 10(5):317-327 (2010).

Wuest, T., et al., "TNF-Selectokine: A Novel Prodrug Generated for Tumor Targeting and Site-specific Activation of Tumor Necrosis Factor," Oncogene, 21(27):4257-4265 (2002).

Xia, B., et al., "Osteoarthritis Pathogenesis: A Review of Molecular Mechanisms," Calcified Tissue International, 95(6):495-505 (2014).

Yamane, B.H., et al., "The development of antibody-IL-2 based immunotherapy with hu14.18-IL2 (EMD-273063) in melanoma and neuroblastoma," Expert Opin Investig Drugs, 18(7):991-1000 (2009).

U.S. Appl. No. 10/651,584, filed Aug. 30, 2003, Lauermann.
U.S. Appl. No. 12/821,711, filed Jun. 23, 2010, Ogawa et al.
U.S. Appl. No. 16/463,218, filed May 22, 2019, Igawa et al., related application.
U.S. Appl. No. 16/463,222, filed May 22, 2019, Igawa et al., related application.
U.S. Appl. No. 16/766,600, filed May 22, 2020, Igawa et al., related application.
U.S. Appl. No. 16/767,085, filed May 26, 2020, Igawa et al., related application.
U.S. Appl. No. 17/058,889, filed Nov. 25, 2020, Hoshino et al., related application.
U.S. Appl. No. 17/058,896, filed Nov. 25, 2020, Ishikawa et al., related application.
U.S. Appl. No. 17/615,633, filed Dec. 1, 2021, Sakurai et al., related application.
U.S. Appl. No. 17/477,983, filed Sep. 17, 2021, Igawa et al., related application.

Hutt, M., et al., "Plasma Half-life Extension of Small Recombinant Antibodies by Fusion to Immunoglobulin-binding Domains," J Biol Chem., 287(7):4462-4469 (2012).

Ishii, A., et al., "A receptor involved in the regulation of the pharmacokinetics of antibody-based pharmaceuticals: FcRn," Nihon Yakurigaku Zasshi. Folia Pharmacologica Japonica, 136(5):280-284 (2010).

Knauf, M. J., et al., "Relationship of Effective Molecular Size to Systemic Clearance in Rats of Recombinant Interleukin-2 Chemically Modified with Water-soluble Polymers," J Biol Chem., 263(29):15064-15070 (1988).

Restriction Requirement dated Sep. 22, 2022 in U.S. Appl. No. 16/767,085, filed May 26, 2020, Igawa et al.

Sandersjoo, L., et al., "A New Prodrug Form of Affibody Molecules (Pro-affibody) is Selectively Activated by Cancer-associated Proteases," Cellular and Molecular Life Sciences, 72(7):1405-1415 (2015).

Schlapschy, M., et al., "Fusion of a recombinant antibody fragment with a homo-amino-acid polymer: effects on biophysical properties and prolonged plasma half-life," Prot Eng Des Sel., 20(6):273-284 (2007).

Seliverstov, et al., "Spinal Muscular Atrophies: Conception," Differential Diagnostics and Prospects for Treatment, 3:9-17 (2015).

U.S. Appl. No. 17/793,587, filed Jul. 18, 2022, Igawa et al., related application.

Alberts, B., et al., "Molecular Biology of The Cell," Fifth Edition, Chapter 3 "Proteins," 125, 136 (2008).

Allegra, C. J., et al., "Phase III Trial Assessing Bevacizumab in Stages II and III Carcinoma of the Colon: Results of NSABP Protocol C-08," J Clin Oncol., 29(1):11-16 (2011).

Badri, H., et al., "Optimization of radiation dosing schedules for proneural glioblastoma," J Math Biol., 72:1301-1336 (2016).

Baylot, V., et al., "TCTP Has a Crucial Role in the Different Stages of Prostate Cancer Malignant 4 Progression 5," TCTP/tpt1—Remodeling Signaling from Stem Cell to Disease. Results and Problems in Cell Differentiation, 64:255-261 (2017).

Dashivets, T., et al., "Oxidation in the complementarity-determining regions differentially influences the properties of therapeutic antibodies," MAbs, 8(8):1525-1535 (2016).

Derksen, P. W. B., et al., "Illegitimate WNT signaling promotes proliferation of multiple myeloma cells," PNAS, 101(16):6122-6127 (2004).

Dirks, P. B., "Brain Tumor Stem Cells: Bringing Order to the Chaos of Brain Cancer," J Clin Oncol., 26(17):2916-2924 (2008).

López-Lázaro, M., "The migration ability of stem cells can explain the existence of cancer of unknown primary site. Rethinking metastasis." Oncoscience, 2(5):467-475 (2015).

Mariuzza, R. A., et al., "The Structural Basis of Antigen-Antibody Recognition," Ann Rev Biophys Biophys Chem., 16:139-159 (1987).

Office Action dated May 24, 2023 in U.S. Appl. No. 16/767,085, filed May 26, 2020, Igawa et al.

Restriction Requirement dated Dec. 8, 2023 in U.S. Appl. No. 17/058,889, filed Nov. 25, 2020, Hoshino et al.

Roitt, I., et al., "Immunology," Fifth Edition, Moscow, Mir, 97-113 (2000).

Singer, M. and Berg, P., "Genes and Genomes," Moscow, Mir, 63 (1998).

Tran, B. and Rosenthal, M. A., "Survival comparison between glioblastoma multiforme and other incurable cancers," J Clin Neurosci., 17:417-421 (2010).

Yarilin, A. A., Immunology Basics: Manual, Fundamentals of Immunology, Moscow, Medicina, 172-174 (1999).

U.S. Appl. No. 18/393,918, filed Dec. 22, 2023, Igawa et al., related application.

U.S. Appl. No. 18/580,385, filed Jan. 18, 2024, Chichili et al., related application.

\* cited by examiner

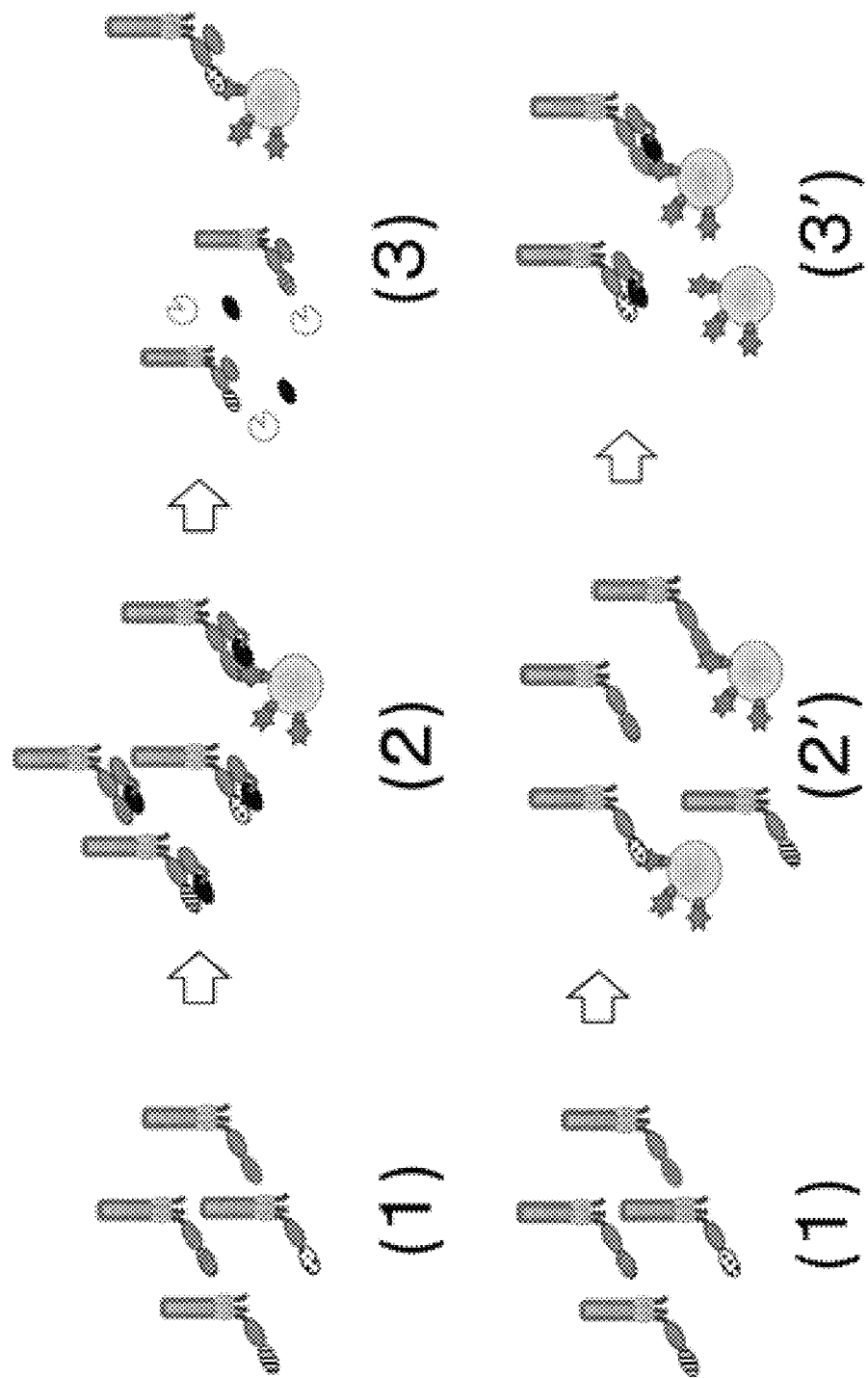

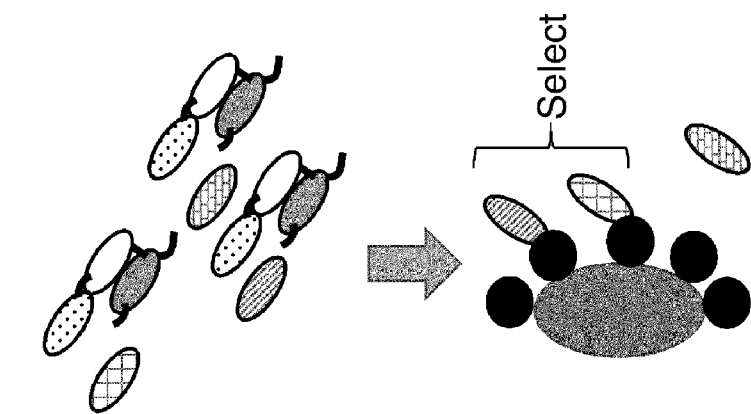
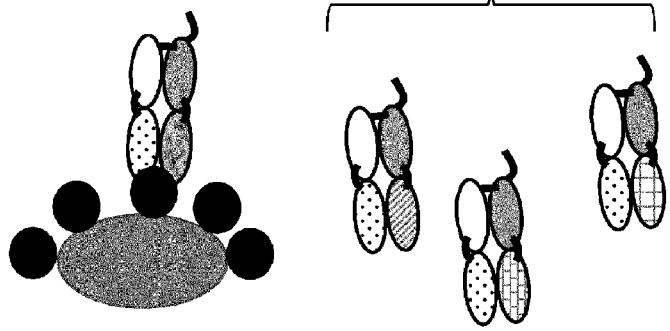
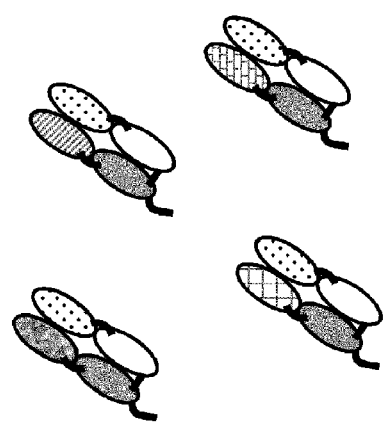

Fig. 11 (A)

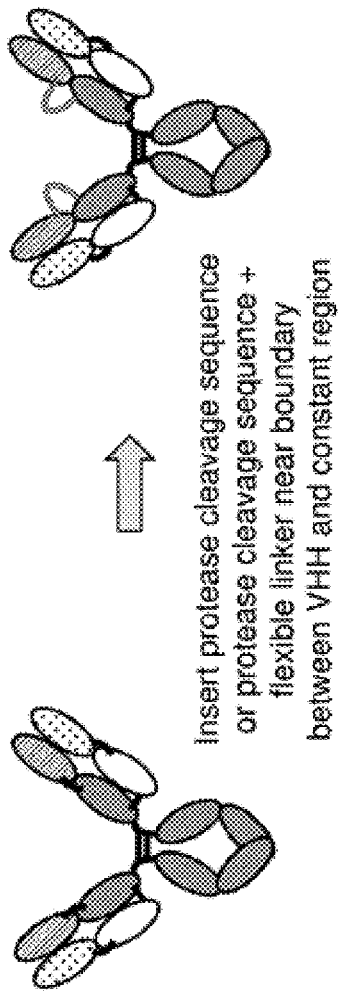

Insert protease cleavage sequence
or protease cleavage sequence +
flexible linker near boundary
between VHH and constant region (B)

| Name of heavy chain | Insertion site | Inserted amino acid sequence |
|---|---|---|
| 6R90H1001 | TVSSAS [insert] TKGP | LSGRSDNH (SEQ ID NO: 12) |
| 6R90H1002 | TVSSAS [insert] TKGP | SGGSGLSGRSDNHGSSGG (SEQ ID NO: 44) |
| 6R90H1003 | TV [insert] SSASTKGP | LSGRSDNHG (SEQ ID NO: 45) |
| 6R90H1004 | TV [insert] SSASTKGP | SGGSGLSGRSDNHGSSGG (SEQ ID NO: 44) |
| 6R90H1005 | TVSSASTK [insert] GP | LSGRSDNHG (SEQ ID NO: 45) |
| 6R90H1006 | TVSSASTK [insert] GP | SGGSGLSGRSDNHGSSGG (SEQ ID NO: 44) |

(SEQ ID NO: 537)

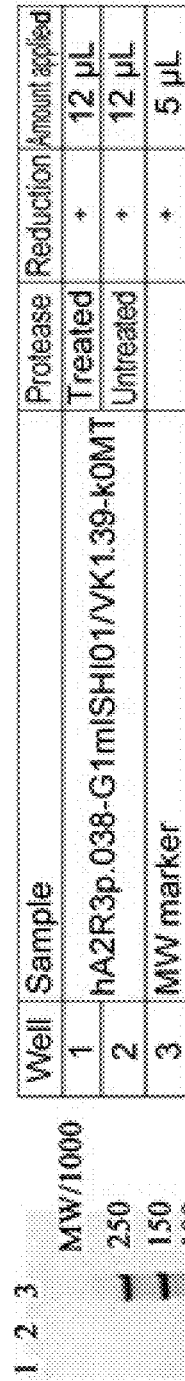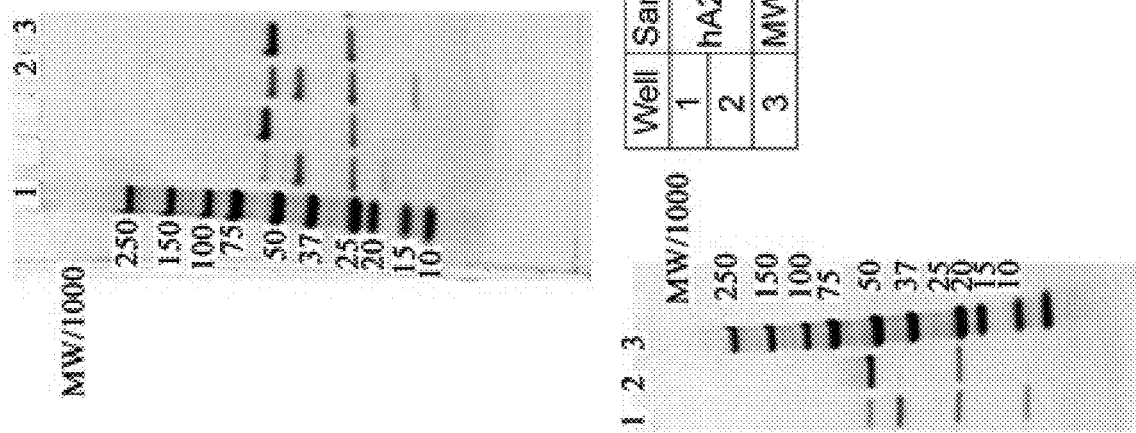
Fig. 45

Fig. 50
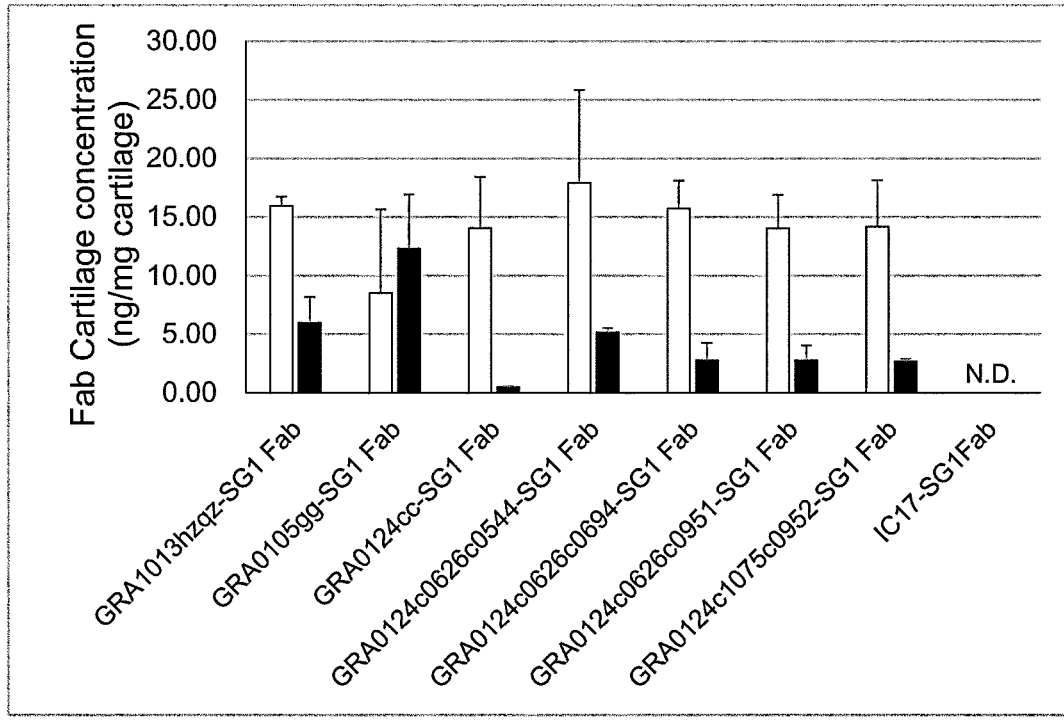
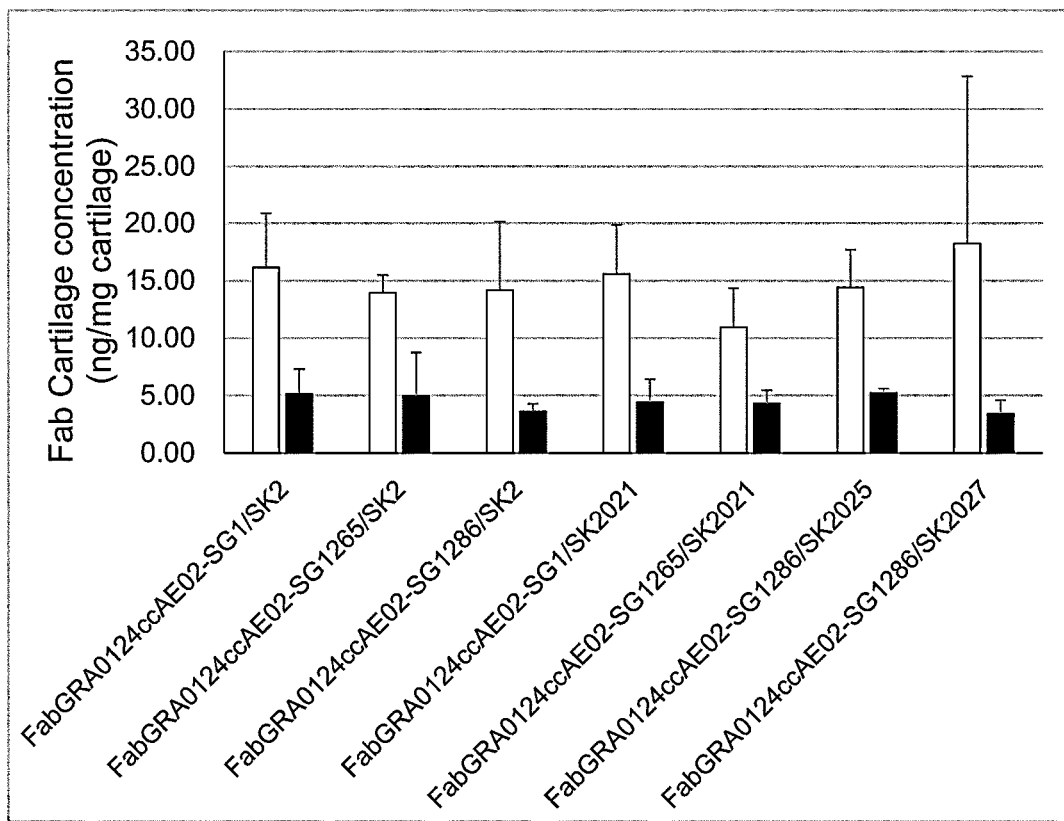

POLYPEPTIDE COMPRISING AGGRECAN BINDING DOMAIN AND CARRYING MOIETY

CROSS-REFERENCE TO RELATED APPLICATIONS

This application is a U.S. National Phase of PCT Application No. PCT/JP2019/021463, filed May 30, 2019, which claims the benefit of Japanese Patent Application No. 2018-103233, filed May 30, 2018, each of which is incorporated herein by reference in its entirety.

REFERENCE TO SEQUENCE LISTING SUBMITTED ELECTRONICALLY

The content of the electronically submitted sequence listing (Name: 6663_0156Sequence_Listing.txt: Size: 1.05 megabytes: and Date of Creation: Nov. 20, 2020) filed with the application is incorporated herein by reference in its entirety.

TECHNICAL FIELD

The present invention relates to a polypeptide comprising an antigen binding domain for a cartilage tissue antigen, and the use of the polypeptide. The present invention further relates to a polypeptide comprising a binding domain for a cartilage tissue antigen and a carrying moiety having an inhibiting domain that inhibits the antigen binding activity of the antigen binding domain, and having a longer half-life than the half-life of the antigen binding domain which exists alone, methods for producing and screening for the polypeptide, a pharmaceutical composition comprising the polypeptide, methods for producing and screening for a binding domain to a cartilage tissue antigen whose antigen binding activity can be inhibited by associating with particular VL, VH or VHH, and a library of fusion polypeptides in which a binding domain to a cartilage tissue antigen whose antigen binding activity can be inhibited by associating with particular VL, VH or VHH.

BACKGROUND ART

Antibodies have received attention as drugs because of being highly stable in plasma and causing few adverse reactions. Among them, many IgG-type antibody drugs have been launched, and a large number of antibody drugs are currently under development (NPL 1 and NPL 2).

Rituxan against CD20, cetuximab against EGFR, Herceptin against HER2, and the like have been approved so far as therapeutic drugs for cancer using antibody drugs (NPL 3). These antibody molecules bind to their antigens expressed on cancer cells and thereby exert cytotoxic activity against the cancer cells through ADCC activity, etc. Such cytotoxic activity based on ADCC activity, etc. is known to depend on the number of antigens expressed on target cells of therapeutic antibodies (NPL 4). Therefore, high expression levels of targeted antigens are preferred from the viewpoint of the effects of therapeutic antibodies. However, if an antigen, albeit having a high expression level, is expressed in normal tissues, the cytotoxic activity based on ADCC activity, etc. is exerted against the normal cells. Hence, adverse reactions become a serious problem. Therefore, it is preferred that antigens targeted by therapeutic antibodies as therapeutic drugs for cancer should be expressed specifically on cancer cells. For example, an antibody molecule against EpCAM known as a cancer antigen had been considered promising as a therapeutic drug for cancer. However, the EpCAM antigen is known to be also expressed in the pancreas. In actuality, it has been reported in clinical trials that the administration of an anti-EpCAM antibody causes pancreatitis as an adverse reaction due to cytotoxic activity against the pancreas (NPL 5).

In the wake of the success of antibody drugs exerting cytotoxic activity based on ADCC activity, second-generation improved antibody molecules exerting strong cytotoxic activity have been reported as a result of, for example, enhancing ADCC activity by the removal of fucose from the N-linked oligosaccharide of a natural human IgG1 Fc region (NPL 6) or enhancing ADCC activity by enhancing binding to Fc gamma RIIIa through the amino acid substitution of a natural human IgG1 Fc region (NPL 7). Improved antibody molecules exerting stronger cytotoxic activity, such as an antibody drug conjugate (ADC) containing an antibody conjugated with a drug having strong cytotoxic activity (NPL 8), and a low-molecular antibody exerting cytotoxic activity against cancer cells by recruiting T cells to the cancer cells (NPL 9) have also been reported as antibody drugs exerting cytotoxic activity against cancer cells under a mechanism other than NK cell-mediated ADCC activity as mentioned above.

Such antibody molecules exerting stronger cytotoxic activity can exert cytotoxic activity even against cancer cells expressing an antigen at a level that is not high, but also exert cytotoxic activity against normal tissues expressing the antigen at a low level, similarly to cancer cells. In actuality, EGFR-BiTE, a bispecific antibody against CD3 and EGFR, can exert strong cytotoxic activity against cancer cells and exert an antitumor effect, by recruiting T cells to the cancer cells, as compared with cetuximab, natural human IgG1 against the EGFR antigen. On the other hand, it has also been found that serious adverse reactions appear by the administration of EGFR-BiTE to cynomolgus monkeys, because EGFR is also expressed in normal tissues (NPL 10). Also, ADC bivatuzumab mertansine containing mertansine conjugated with an antibody against CD44v6 highly expressed on cancer cells has been clinically found to cause severe dermal toxicity and hepatoxicity, because CD44v6 is also expressed in normal tissues (NPL 11).

As mentioned above, use of an antibody that can exert strong cytotoxic activity even against cancer cells expressing an antigen at low levels requires the target antigen to be expressed in an exceedingly cancer-specific manner. However, considering that a target antigen HER2 of Herceptin or a target antigen EGFR of cetuximab is also expressed in normal tissues, only a limited number of cancer antigens may be expressed in an exceedingly cancer-specific manner. Therefore, adverse reactions ascribable to a cytotoxic effect on normal tissues may become a problem, though cytotoxic activity against cancer can be strengthened.

Recently, ipilimumab, which enhances tumor immunity by inhibiting CTLA4 contributing to immunosuppression in cancer, has been shown to extend overall survival in metastatic melanoma (NPL 12). However, ipilimumab systemically inhibits CTLA4 and therefore advantageously causes autoimmune disease-like severe adverse reactions due to the systemic activation of immunity, though enhancing the tumor immunity (NPL 13).

Meanwhile, antibody drugs exerting a therapeutic effect by inhibiting inflammatory cytokines in inflammatory or autoimmune diseases are known as antibody drugs against diseases other than cancer (NPL 14). It is known that, for example, Remicade or Humira targeting TNF, and Actemra targeting IL-6R exert a high therapeutic effect on rheumatoid arthritis, whereas infectious disease is seen as an adverse reaction due to the systemic neutralization of these cytokines (NPL 15).

Osteoarthritis (OA) is the most common degenerative joint disease among elderly people. OA affects majority of individuals over the age of 65 and is a leading musculoskeletal cause of impaired mobility. OA patients are suffering from cartilage matrix degradation, osteophyte generation and chronic pain in affected joints. Because the precise molecular mechanisms which are involved in the degradation of cartilage matrix and development of OA are poorly understood, there are currently no disease modifying drug for OA (NPL 19 and NPL 20).

Articular cartilage is mainly composed of tissue fluid, type II collagen, and proteoglycans. About $65-80\%$ of cartilage is tissue fluid. Collagen type II, and proteoglycans account for 15-22 and 4-7% of the cartilage wet weight, respectively. Aggrecan is the major proteoglycan in the articular cartilage. This molecule is important in the proper functioning of articular cartilage. Aggrecan provides a hydrated gel structure that endows the cartilage with load-bearing properties. Aggrecan is a multimodular molecule expressed by chondrocytes. Its core protein is composed of three globular domains (G1, G2, and G3) and a large extended region (CS) between G2 and G3 for glycosaminoglycan chain attachment. Aggrecan degradation occur during osteoarthritis (OA) disease progression, and proteases such as ADAMTS and MMP involve the degradation (NPL 21).

Various techniques have been developed as techniques applicable to second-generation antibody drugs. For example, techniques of improving effector functions, antigen binding capacity, pharmacokinetics, or stability or reducing a risk of immunogenicity have been reported (NPL 16). However, there are still a few reports on techniques that allow antibody drugs to act specifically on a target tissue in order to solve adverse reactions as described above. The reported techniques include a method which involves: connecting an antibody to a masking peptide via a linker that is cleaved by protease expressed at a lesion site such as a cancer tissue or an inflammatory tissue, thereby masking the antigen binding site of the antibody with the masking peptide and inhibiting the antigen binding activity of the antibody; and dissociating the masking peptide therefrom by the protease cleavage of this linker so that the antibody restores its antigen binding activity and becomes capable of binding to the antigen in a target pathological tissue (NPL 17 and NPL 18 and PTL 1).

CITATION LIST

Patent Literature

[PTL 1] International Publication No. WO2010/081173

Non Patent Literature

[NPL 1] Monoclonal antibody successes in the clinic. Janice M Reichert, Clark J Rosensweig, Laura B Faden & Matthew C Dewitz, Nat. Biotechnol. (2005) 23, 1073-1078
[NPL 2] The therapeutic antibodies market to 2008. Pavlou A K, Belsey M J., Eur. J. Pharm. Biopharm. (2005) 59 (3), 389-396
[NPL 3] Monoclonal antibodies: versatile platforms for cancer immunotherapy. Weiner L M, Surana R, Wang S., Nat. Rev. Immunol. (2010) 10 (5), 317-327
[NPL 4] Differential responses of human tumor cell lines to anti-p185HER2 monoclonal antibodies. Lewis G D, Figari I, Fendly B, Wong W L, Carter P, Gorman C, Shepard H M, Cancer Immunol. Immunotherapy (1993) 37, 255-263
[NPL 5] ING-1, a monoclonal antibody targeting Ep-CAM in patients with advanced adenocarcinomas. de Bono J S, Tolcher A W, Forero A, Vanhove G F, Takimoto C, Bauer R J, Hammond L A, Patnaik A, White M L, Shen S, Khazaeli M B, Rowinsky E K, LoBuglio A F, Clin. Cancer Res. (2004) 10 (22), 7555-7565
[NPL 6] Non-fucosylated therapeutic antibodies as next-generation therapeutic antibodies. Satoh M, Iida S, Shitara K., Expert Opin. Biol. Ther. (2006) 6 (11), 1161-1173
[NPL 7] Optimizing engagement of the immune system by anti-tumor antibodies: an engineer's perspective. Desjarlais J R, Lazar G A, Zhukovsky E A, Chu S Y., Drug Discov. Today (2007) 12 (21-22), 898-910
[NPL 8] Antibody-drug conjugates: targeted drug delivery for cancer. Alley S C, Okeley N M, Senter P D., Curr. Opin. Chem. Biol. (2010) 14 (4), 529-537
[NPL 9] BiTE: Teaching antibodies to engage T-cells for cancer therapy. Baeuerle P A, Kufer P, Bargou R., Curr. Opin. Mol. Ther. (2009) 11 (1), 22-30
[NPL 10] T cell-engaging BiTE antibodies specific for EGFR potently eliminate KRAS- and BRAF-mutated colorectal cancer cells. Lutterbuese R, Raum T, Kischel R, Hoffmann P, Mangold S, Rattel B, Friedrich M, Thomas O, Lorenczewski G, Rau D, Schaller E, Herrmann I, Wolf A, Urbig T, Baeuerle P A, Kufer P., Proc. Natl. Acad. Sci. U.S.A. (2010) 107 (28), 12605-12610
[NPL 11] Phase I trial with the CD44v6-targeting immunoconjugate bivatuzumab mertansine in head and neck squamous cell carcinoma. Riechelmann H, Sauter A, Golze W, Hanft G, Schroen C, Hoermann K, Erhardt T, Gronau S., Oral Oncol. (2008) 44 (9), 823-829
[NPL 12] Ipilimumab in the treatment of melanoma. Trinh V A, Hwu W J., Expert Opin. Biol. Ther., (2012) April 14 (doi: 10.1517/14712598.2012.675325)
[NPL 13] IPILIMUMAB—A NOVEL IMMUNOMODULATING THERAPY CAUSING AUTOIMMUNE HYPOPHYSITIS: A CASE REPORT AND REVIEW. Juszczak A, Gupta A, Karavitaki N, Middleton M R, Grossman A., Eur. J. Endocrinol. (2012) April 10 (doi: 10.1530/EJE-12-0167)
[NPL 14] The Japanese experience with biologic therapies for rheumatoid arthritis. Takeuchi T, Kameda H., Nat. Rev. Rheumatol. (2010) 6 (11), 644-652
[NPL 15] Current evidence for the management of rheumatoid arthritis with biological disease-modifying antirheumatic drugs: a systematic literature review informing the EULAR recommendations for the management of RA. Nam J L, Winthrop K L, van Vollenhoven R F, Pavelka K, Valesini G, Hensor E M, Worthy G, Landewe R, Smolen J S, Emery P, Buch M H., Ann. Rheum. Dis. (2010) 69 (6), 976-986
[NPL 16] Antibody engineering for the development of therapeutic antibodies. Kim S J, Park Y, Hong H J., Mol. Cells. (2005) 20 (1), 17-29
[NPL 17] Tumor-specific activation of an EGFR-targeting probody enhances therapeutic index. Desnoyers L R, Vasiljeva O, Richardson J H, Yang A, Menendez E E, Liang T W, Wong C, Bessette P H, Kamath K, Moore S J, Sagert J G, Hostetter D R, Han F, Gee J, Flandez J, Markham K, Nguyen M, Krimm M, Wong K R, Liu S, Daugherty P S, West J W, Lowman H B. Sci Transl Med. 2013 Oct. 16; 5(207): 207ra144.

[NPL 18] Probody therapeutics for targeting antibodies to diseased tissue. Polu K R, Lowman H B. Expert Opin Biol Ther. 2014 August; 14(8): 1049-53.

[NPL 19] Nature Reviews Disease Primers volume 2, Article number: 16072 (2016)

[NPL 20] Calcif Tissue Int. 2014 December; 95(6): 495-505

[NPL 21] Cell Research (2002) 12: 19-32

SUMMARY OF INVENTION

Technical Problem

The present invention provides antigen binding polypeptides that bind to an antigen present in a cartilage tissue. The present invention further provides use of the antigen binding polypeptides for delivery and retention of substances such as pharmaceuticals in cartilage tissue.

The present invention further provides a polypeptide which carries an antigen binding polypeptide that binds to a cartilage tissue and is capable of releasing the antigen binding polypeptide from the polypeptide. The present inventors have thought that the techniques of dissociating, by protease cleavage, a masking peptide inhibiting the antigen binding activity of an antibody so that the antibody restores its antigen binding activity, as described above might cause adverse reactions, because the antibody cleaved at a lesion site may distribute to normal tissues through blood flow, as the cleavage by protease is irreversible. Further, there has been a problem that it is difficult for conventional antibodies to target antigens present in a deep part of a cartilage tissue since such antibodies have a high molecular weight.

The present invention has been made on the basis of such an idea. An object of the present invention is to provide antigen binding polypeptides that bind to an antigen present in a cartilage tissue, and also to provide use of the antigen binding polypeptides. A further object of the present invention is to provide a pharmaceutical composition useful in disease treatment with a reduced adverse reaction, and an active ingredient thereof. Further, an object of the present invention is to provide a pharmaceutical composition that can reach a deep part in a target cartilage tissue well, and an active ingredient thereof. Another object of the present invention is to provide a pharmaceutical composition that retain for a long time period in a cartilage issue. Another object of the present invention is to provide methods for screening for and producing the pharmaceutical composition and the active ingredient.

Solution to Problem

Antibodies that bind to cartilage tissue have been produced using molecules present in a cartilage tissue as antigens. Produced antibodies effectively suppressed the proteolytic cleavage of Aggrecan, suggesting that these antibodies effectively interfere with the Aggrecan-protease interaction. As shown in Example 25 of the specification, it was also revealed that antibodies against a molecule present in a cartilage tissue were capable of deeply penetrating into the cartilage tissue, and retaining for a long period. The result suggests that anti-cartilage antibodies are useful for delivering desired drug molecules and/or functional antibodies themselves to cartilage tissue and retaining them in the cartilage for a long period.

The present inventors provide diligent studies and consequently developed a polypeptide comprising an antigen binding domain and a carrying moiety having an inhibiting domain that inhibits the binding activity of the antigen binding domain, and having a longer half-life than the half-life of the antigen binding domain which exists alone. It is considered that use of the polypeptide can allow the antigen binding domain to restore its antigen binding activity in a disease tissue and exert the antigen binding activity in the disease tissue. Furthermore, the systemic distribution of an activated form of the antigen binding domain can be suppressed owing to the difference in half-life between the polypeptide comprising the antigen binding domain whose antigen binding activity is inhibited and a polypeptide comprising the antigen binding domain whose antigen binding activity is restored. Moreover, the present inventors have found that the polypeptide or a pharmaceutical composition comprising the polypeptide is useful in disease treatment and also found that: the polypeptide or the pharmaceutical composition is useful in disease treatment which involves administering the polypeptide; and the polypeptide is useful in the production of a drug for disease treatment. The present inventors have further developed methods for screening for and producing the polypeptide, methods for producing and screening for an antigen binding domain for a cartilage tissue whose antigen binding activity can be inhibited by associating with particular VL, VH or VHH, and a library including an antigen binding domain for a cartilage tissue whose antigen binding activity can be inhibited by associating with particular VL, VH or VHH, completing the present invention.

The present invention is based on these findings and specifically encompasses exemplary embodiments described below.

(A1) This item encompasses following embodiments in alternative manner:

(A1-1) A polypeptide comprising an antigen binding domain and a carrying moiety, wherein the carrying moiety has an inhibiting domain that inhibits the antigen binding activity of the antigen binding domain, wherein the antigen is a molecule present in a cartilage tissue.

(A1-2) A polypeptide comprising an antigen binding domain and a carrying moiety, wherein the antigen binding domain has a shorter half-life in blood than that of the carrying moiety that has an inhibiting domain that inhibits the antigen binding activity of the antigen binding domain, and wherein the antigen is a molecule present in a cartilage tissue.

Above item (A1) (which encompasses the embodiments of (A-1) and (A-2) above) encompasses following embodiments:

(1-1) The polypeptide according to (A1-2), wherein the half-life of the molecule in the cartilage tissue is 1 month or more, 2 months or more, 6 months or more, 1 year or more, or 5 years or more.

(1-2) The polypeptide according to (A1), wherein the relative amount (% wet weight) of the molecule in the cartilage tissue is 1% or more, 2% or more, 3% or more, 4% or more, 5% or more, 10% or more, 15% or more, or 20% or more.

(1-3) The polypeptide according to (A1), wherein the molecule present in a cartilage tissue is extracellular matrix in the cartilage tissue selected from the group consisting of:
1. collagen,
2. proteoglycan,
3. glycoprotein, 4. sugar chain, and
5. other proteins.

(1-4) The polypeptide according to (1-3), wherein collagen is selected from the group consisting of: Collagen type II(fibrillar collagen), Collagen type III (fibrillar collagen), Collagen type IV, Collagen type V(fibrillar collagen), Collagen type VI, Collagen type IX, Collagen type X, Collagen type XI(fibrillar collagen), Collagen type XII, Collagen type XIV, Collagen type XVI, Collagen type XXII, Collagen type XXIV(fibrillar collagen), and Collagen type XXVII (fibrillar collagen).

(1-5) The polypeptide according to (1-3), wherein proteoglycans are selected from the group consisting of: Aggrecan, Vercican, Perlecan, Syndecan, Lubricin, Link protein, and Small leucine-rich repeat proteoglycans.

(1-6) The polypeptide according to (1-5), wherein Small leucine-rich repeat proteoglycans are selected from the group consisting of: Decorin, Biglycan, Asporin, Fibromodulin, Lumican, Keratocan, Osteoadherin, Proline-/arginine-rich end leucine-rich repeat protein, Epiphycan, Mimecan, Opticin, Chondroadherin, and Chondroadherin-like.

(1-7) The polypeptide according to (1-3), wherein sugar chain is selected from the group consisting of: Hyaluronic acid (HA), Chondroitin sulfate (CS), Keratan sulfate (KS), and Dermatan sulfate (DS).

(1-8) The polypeptide according to (A1), wherein the molecule present in a cartilage tissue is extracellular matrix in the cartilage tissue selected from the group consisting of: Thrombospondin, Matrilin, WARP, UCMA, CILP, Fibronectin, Lamin, and Nidgen.

(1-9) The polypeptide according to (A1), wherein the molecule is ADAMTS4, ADAMTS5, or MMP-13.

(1-10) The polypeptide according to (1-9), wherein the antigen binding domain inhibits the cleavage activity against Aggrecan of ADAMTS4, ADAMTS5, or MMP-13.

(2) This item encompasses following embodiments in alternative manner:

(2-1) The polypeptide according to (A1), wherein the molecule is a component of Extracellular matrix in the cartilage tissue.

(2-2) The polypeptide according to (2-1), wherein the Extracellular matrix is Aggrecan or Collagen.

(3-1) The polypeptide according to (2) (which encompasses the embodiments of (2-1) and (2-2) above), wherein the antigen binding domain binds to an epitope within Aggrecan, wherein the antigen binding domain competes for binding the epitope with an antibody selected from the group consisting of 1)-3) below:
  1) An antibody comprising VH sequence of SEQ ID NO: 512 and VL sequence of SEQ ID NO: 513,
  2) An antibody comprising VH sequence of SEQ ID NO: 514 and VL sequence of SEQ ID NO: 515, and
  3) An antibody comprising VH sequence of SEQ ID NO: 516 and VL sequence of SEQ ID NO: 517.

(3-2) The polypeptide according to (2) (which encompasses the embodiments of (2-1) and (2-2) above), wherein the antigen binding domain binds to an epitope selected from the group consisting of 1)-6) below:
  1) amino acids at positions 382-403 of the amino acid sequence set forth in SEQ ID NO: 509,
  2) amino acids at positions 1669-1690 of the amino acid sequence set forth in SEQ ID NO: 509,
  3) amino acids at positions 1838-1859 of the amino acid sequence set forth in SEQ ID NO: 509,
  4) amino acids at positions 1943-1964 of the amino acid sequence set forth in SEQ ID NO: 509,
  5) amino acids at positions 2043-2064 of the amino acid sequence set forth in SEQ ID NO: 509, and
  6) amino acids at positions 2221-2242 of the amino acid sequence set forth in SEQ ID NO: 509.

(3-3) The polypeptide according to (2) (which encompasses the embodiments of (2-1) and (2-2) above), wherein the antigen binding domain binds to an epitope selected from the group consisting of 1) below:
  1) amino acids at positions 350-371, 393-414, 450-471, 666-687, 689-710, 943-964, 981-1002, 1000-1021, 1019-1040, 1038-1059, 1057-1078, 1076-1097, 1095-1116, 1114-1135, 1133-1154, 1152-1173, 1171-1192, 1190-1211, 1209-1230, 1228-1249, 1247-1268, 1266-1287, 1285-1306, 1304-1325, 1323-1344, 1342-1363, 1361-1382, 1380-1401, 1399-1420, 1437-1458, 1476-1497, 1514-1535, or 1575-1596 of the amino acid sequence set forth in SEQ ID NO: 509.

(4-1) The polypeptide according to (1), wherein the antigen binding domain binds to an epitope within Aggrecan, wherein the antigen binding domain competes for binding the epitope with an antibody selected from the group consisting of 1) below:
  1) MAB1220 (R&D SYSTEMS, Monoclonal Mouse IgG2B Clone #179509).

(4-2) The polypeptide according to (1), wherein the antigen binding domain binds to an epitope within a polypeptide selected from the group consisting of 1) below:
  1) amino acids at positions 48-673 (G1-IGD-G2 Domain) of the amino acid sequence set forth in SEQ ID NO: 509.

(5-1) The polypeptide according to (1) (item (1) encompasses any one of the embodiments of (1-1) to (4-2)), wherein the antigen binding domain comprises (a) a VH sequence having at least 95% sequence identity to the amino acid sequence of SEQ ID NO: 512 or 514 and/or (b) a VL sequence having at least 95% sequence identity to the amino acid sequence of SEQ ID NO: 513 or 515.

(5-2) The polypeptide according to (1) (item (1) encompasses any one of the embodiments of (1-1) to (4-2)), wherein the antigen binding domain comprises (a) a VH sequence having at least 95% sequence identity to the amino acid sequence of SEQ ID NO: 516 and/or (b) a VL sequence having at least 95% sequence identity to the amino acid sequence of SEQ ID NO: 517.

(5-3) The polypeptide according to (1) (item (1) encompasses any one of the embodiments of (1-1) to (4-2)), wherein the antigen binding domain comprises any one of the combinations of H-chain CDR1, CDR2, and CDR3 and L-chain CDR1, CDR2, and CDR3 selected from 1) to 3) below, or any one of the combinations of H-chain CDR1, CDR2, and CDR3 and L-chain CDR1, CDR2, and CDR3 of antibody variable regions functionally equivalent thereto:
  1) H-chain CDR1, CDR2, and CDR3 comprised in the antibody variable region are identical to the amino acid sequences of the CDR1, CDR2, and CDR3 regions comprised in SEQ ID NO:512; and L-chain CDR1, CDR2, and CDR3 comprised in the antibody variable region are identical to the amino acid sequences of the CDR1, CDR2, and CDR3 regions comprised in SEQ ID NO:513;
  2) H-chain CDR1, CDR2, and CDR3 comprised in the antibody variable region are identical to the amino acid sequences of the CDR1, CDR2, and CDR3 regions comprised in SEQ ID NO:514; and L-chain CDR1, CDR2, and CDR3 comprised in the antibody variable region are identical to the amino acid sequences of the CDR1, CDR2, and CDR3 regions comprised in SEQ ID NO:515; and 3) H-chain CDR1, CDR2, and CDR3 comprised in the antibody variable region are identical to the amino acid sequences of the CDR1, CDR2, and CDR3 regions comprised in SEQ ID NO:516; and L-chain CDR1, CDR2, and CDR3 comprised in the antibody variable region are identical to the amino acid sequences of the CDR1, CDR2, and CDR3 regions comprised in SEQ ID NO:517.

(5-4) The polypeptide according to (1) (item (1) encompasses any one of the embodiments of (1-1) to (4-2)), wherein the antigen binding domain comprises any one of the combinations of H-chain CDR1, CDR2, and CDR3 and L-chain CDR1, CDR2, and CDR3 of antibody variable regions selected from 1) to 3) below, or antibody variable regions functionally equivalent thereto:

1) An antibody H-chain variable region comprising the amino acid sequences of SEQ ID NO:512; and an antibody L-chain variable region comprising the amino acid sequences of SEQ ID NO:513;
2) An antibody H-chain variable region comprising the amino acid sequences of SEQ ID NO:514; and an antibody L-chain variable region comprising the amino acid sequences of SEQ ID NO:515; and
3) An antibody H-chain variable region comprising the amino acid sequences of SEQ ID NO:516; and an antibody L-chain variable region comprising the amino acid sequences of SEQ ID NO:517.

(A2) The polypeptide according to (A1), wherein the molecular weight of the antigen binding domain is smaller than that of the carrying moiety.

(A3) This item encompasses following embodiments in alternative manner:
 (A3-1) The polypeptide according to (A1) or (A2), wherein the molecular weight of the antigen binding domain is 120 kDa or smaller, 100 kDa or smaller, 80 kDa or smaller, 60 kDa or smaller, 40 kDa or smaller, or 20 kDa or smaller.
 (A3-2) The polypeptide according to (A1) or (A2), wherein the antigen binding domain comprises an antibody.
 (A3-3) The polypeptide according to (A3-2), wherein the antibody is F(ab')2, Fab, scFv, VHH, VL, VH or single domain antibody.

(A4) The polypeptide according to any one of (A1) to (A3), wherein the carrying moiety has FcRn binding activity, and the antigen binding domain has no FcRn binding activity or has weaker FcRn binding activity than that of the carrying moiety.

(A5) The polypeptide according to any one of (A1) to (A4), wherein the antigen binding domain is capable of being released from the polypeptide, and the antigen binding domain released from the polypeptide has higher antigen binding activity than that before the release.

(A6) The polypeptide according to any one of (A1) to (A5), wherein the inhibiting domain of the carrying moiety associates with the antigen binding domain and thereby inhibits the antigen binding activity of the antigen binding domain.

(A7) This item encompasses following embodiments in alternative manner:
 (A7-1) The polypeptide according to (A5), wherein the polypeptide comprises a cleavage site, wherein the cleavage site is cleaved so that the antigen binding domain becomes capable of being released from the polypeptide.
 (A7-2) The polypeptide according to (A6), wherein the polypeptide comprises a cleavage site, wherein the cleavage site is cleaved so that the association of the inhibiting domain of the carrying moiety with the antigen binding domain is canceled.

(A8) This item encompasses following embodiments in alternative manner:
 (A8-1) The polypeptide according to (A7), wherein in the polypeptide, the N terminus of the carrying moiety and the C terminus of the antigen binding domain are fused via a linker or without a linker, or wherein in the polypeptide, the C terminus of the carrying moiety and the N terminus of the antigen binding domain are fused via a linker or without a linker.
 (A8-2) The polypeptide according to (A7), wherein the polypeptide further has a protease cleavage sequence, wherein the cleavage sequence is located between the N terminus of the carrying moiety and the C terminus of the antigen binding domain, the C terminus of the carrying moiety and the N terminus of the antigen binding domain, within the sequence of the antigen binding domain, or within the sequence of the carrying moiety.

(A9) The polypeptide according to (A7), wherein the cleavage site comprises a protease cleavage sequence.

(A10) The polypeptide according to (A9), wherein the protease is protease specific for a target tissue.

(A11) The polypeptide according to (A10), wherein the target tissue is an inflammatory tissue.

(A12) The polypeptide according to (A9), wherein the protease is at least one protease selected from matriptase, urokinase (uPA), and metalloproteinase.

(A13) The polypeptide according to (A12), wherein the protease is at least one protease selected from MT-SP1, uPA, MMP1, MMP2, MMP3, MMP7, MMP9, MMP13, MMP14, ADAM17, ADAMTS4, and ADAMTS5.

(A14) The polypeptide according to (A9), wherein the protease cleavage sequence comprises a sequence selected from SEQ ID NOs: 494.

(A15) The polypeptide according to any one of (A9) to (A14), wherein a first flexible linker is further attached to one end of the protease cleavage sequence.

(A16) The polypeptide according to (A15), wherein a second flexible linker is further attached to the other end of the protease cleavage sequence.

(A17) The polypeptide according to (A15), wherein the first flexible linker is a flexible linker consisting of a glycine-serine polymer.

(A18) The polypeptide according to (A16), wherein the second flexible linker is a flexible linker consisting of a glycine-serine polymer.

(A19) The polypeptide according to any one of (A1) to (A18), wherein the antigen binding domain comprises a single-domain antibody or is a single-domain antibody, wherein the inhibiting domain of the carrying moiety inhibits the antigen binding activity of the single-domain antibody.

(A20) The polypeptide according to (A19), wherein the single-domain antibody is VHH, VH having antigen binding activity by itself, or VL having antigen binding activity by itself.

(A21) The polypeptide according to any one of (A1) to (A20), wherein the antigen binding domain comprises a single-domain antibody, and the inhibiting domain of the carrying moiety is VHH, antibody VH, or antibody VL, wherein the antigen binding activity of the single-domain antibody is inhibited by the VHH, the antibody VH, or the antibody VL.

(A22) The polypeptide according to any one of (A1) to (A21), wherein the antigen binding domain comprises a single-domain antibody, and the inhibiting domain of the carrying moiety is VHH, antibody VH, or antibody VL, wherein the antigen binding activity of the single-domain antibody is inhibited by associating with the VHH, the antibody VH, or the antibody VL.

(A23) The polypeptide according to any one of (A19) to (A22), wherein the single-domain antibody is VHH or VH having antigen binding activity by itself, and the inhibiting domain of the carrying moiety is antibody VL, wherein the antigen binding activity of the VHH or the VH having antigen binding activity by itself is inhibited by associating with the antibody VL.

(A24) The polypeptide according to any one of (A19) to (A23), wherein the single-domain antibody is VHH, wherein the VHH has an amino acid substitution at at least one position selected from amino acid positions 37, 44, 45, and 47 (all conforming to the Kabat numbering).

(A25) The polypeptide according to any one of (A19) to (A23), wherein the single-domain antibody is VHH, wherein the VHH contains at least one amino acid selected from amino acids 37V, 44G, 45L, and 47W (all conforming to the Kabat numbering).

(A26) The polypeptide according to any one of (A19) to (A23), wherein the single-domain antibody is VHH, wherein the VHH contains at least one amino acid substitution selected from amino acid substitutions F37V, Y37V, E44G, Q44G, R45L, H45L, G47W, F47W, L47W, T47W, and S47W (all conforming to the Kabat numbering).

(A27) The polypeptide according to any one of (A19) to (A23), wherein the single-domain antibody is VHH, wherein the VHH has amino acid substitutions at at least one set of positions selected from positions 37/44, positions 37/45, positions 37/47, positions 44/45, positions 44/47, positions 45/47, positions 37/44/45, positions 37/44/47, positions 37/45/47, positions 44/45/47, and positions 37/44/45/47 (all conforming to the Kabat numbering).

(A28) The polypeptide according to any one of (A19) to (A23), wherein the single-domain antibody is VHH, wherein the VHH contains at least one set of amino acids selected from 37V/44G, 37V/45L, 37V/47W, 44G/45L, 44G/47W, 45L/47W, 37V/44G/45L, 37V/44G/47W, 37V/45L/47W, 44G/45L/47W, and 37V/44G/45L/47W (all conforming to the Kabat numbering).

(A29) The polypeptide according to any one of (A19) to (A23), wherein the single-domain antibody is VHH, wherein the VHH contains at least one set of amino acid substitutions selected from F37V/R45L, F37V/G47W, R45L/G47W, and F37V/R45L/G47W (all conforming to the Kabat numbering).

(A30) The polypeptide according to any one of (A19) to (A22), wherein the single-domain antibody is VL having antigen binding activity by itself, and the inhibiting domain of the carrying moiety is antibody VH, wherein the antigen binding activity of the VL having antigen binding activity by itself is inhibited by associating with the antibody VH.

(A31) The polypeptide according to any one of (A1) to (A30), wherein the carrying moiety has a FcRn binding region.

(A32) The polypeptide according to any one of (A1) to (A31), wherein the carrying moiety comprises an antibody constant region.

(A33) The polypeptide according to (A32), wherein the antibody constant region of the carrying moiety and the antigen binding domain are fused via a linker or without a linker.

(A34) The polypeptide according to (A32), wherein the carrying moiety comprises an antibody heavy chain constant region, wherein the antibody heavy chain constant region and the antigen binding domain are fused via a linker or without a linker.

(A35) The polypeptide according to (A32), wherein the carrying moiety comprises an antibody light chain constant region, wherein the antibody light chain constant region and the antigen binding domain are fused via a linker or without a linker.

(A36) The polypeptide according to (A34), wherein in the polypeptide, the N terminus of the antibody heavy chain constant region of the carrying moiety and the C terminus of the antigen binding domain are fused via a linker or without a linker, and the polypeptide further has a protease cleavage sequence, wherein the protease cleavage sequence is located in the sequence of the antigen binding domain, or on the antigen binding domain side with respect to amino acid position 122 (EU numbering) of the antibody heavy chain constant region.

(A37) The polypeptide according to (A35), wherein in the polypeptide, the N terminus of the antibody light chain constant region of the carrying moiety and the C terminus of the antigen binding domain are fused via a linker or without a linker, and the polypeptide further has a protease cleavage sequence, wherein the protease cleavage sequence is located in the sequence of the antigen binding domain, or on the antigen binding domain side with respect to amino acid position 113 (EU numbering) (Kabat numbering position 113) of the antibody light chain constant region.

(A38) The polypeptide according to any one of (A33) to (A35), wherein in the polypeptide, the N terminus of the antibody constant region of the carrying moiety and the C terminus of the antigen binding domain are fused via a linker or without a linker, the antigen binding domain is a single-domain antibody prepared from VH, or VHH, and the polypeptide further has a protease cleavage sequence, wherein the protease cleavage sequence is located in the sequence of the antibody constant region, or on the antibody constant region side with respect to amino acid position 109 (Kabat numbering) of the single-domain antibody of the antigen binding domain.

(A39) The polypeptide according to (A33), wherein in the polypeptide, the N terminus of the antibody constant region of the carrying moiety and the C terminus of the antigen binding domain are fused via a linker or without a linker, and the polypeptide further has a protease cleavage sequence, wherein the protease cleavage sequence is located near the boundary between the antigen binding domain and the antibody constant region.

(A40) The polypeptide according to (A34), wherein in the polypeptide, the N terminus of the antibody heavy chain constant region of the carrying moiety and the C terminus of the antigen binding domain are fused via a linker or without a linker, and the polypeptide further has a protease cleavage sequence, wherein the protease cleavage sequence is located near the boundary between the antigen binding domain and the antibody heavy chain constant region.

(A41) The polypeptide according to (A35), wherein in the polypeptide, the N terminus of the antibody light chain constant region of the carrying moiety and the C terminus of the antigen binding domain are fused via a linker or without a linker, and the polypeptide further has a protease cleavage sequence, wherein the protease cleavage sequence is located near the boundary between the antigen binding domain and the antibody light chain constant region.

(A42) The polypeptide according to (A40), wherein the antigen binding domain is a single-domain antibody prepared from VH, or VHH, and the protease cleavage sequence is located at any position between amino acid position 109 (Kabat numbering) of the single-domain antibody of the antigen binding domain and amino acid position 122 (EU numbering) of the antibody heavy chain constant region.

(A43) The polypeptide according to (A41), wherein the antigen binding domain is a single-domain antibody prepared from VH, or VHH, and the protease cleavage sequence is located at any position between amino acid position 109 (Kabat numbering) of the single-domain antibody of the antigen binding domain and amino acid position 113 (EU numbering) (Kabat numbering position 113) of the antibody light chain constant region.

(A44) The polypeptide according to (A40), wherein the antigen binding domain is a single-domain antibody prepared from VL, and the protease cleavage sequence is located at any position between amino acid position 104 (Kabat numbering) of the single-domain antibody of the antigen binding domain and amino acid position 122 (EU numbering) of the antibody heavy chain constant region.

(A45) The polypeptide according to (A41), wherein the antigen binding domain is a single-domain antibody prepared from VL, and the protease cleavage sequence is located at any position between amino acid position 109 (Kabat numbering) of the single-domain antibody of the antigen binding domain and amino acid position 113 (EU numbering) (Kabat numbering position 113) of the antibody light chain constant region.

(A46) The polypeptide according to any one of (A32) to (A45), wherein the antibody constant region of the polypeptide is an IgG antibody constant region.

(A47) The polypeptide according to any one of (A1) to (A46), wherein the polypeptide is an IgG antibody-like molecule.

(A48) The polypeptide according to any one of (A1) to (A47), wherein when the antigen binding domain is assayed in an unreleased state by use of BLI (bio-layer interferometry) (Octet), the binding of the antigen binding domain to the antigen is not seen.

(A49) The polypeptide according to any one of (A1) to (A48), wherein a second antigen binding domain is further linked to the antigen binding domain.

(A50) The polypeptide according to (A49), wherein the second antigen binding domain has antigen binding specificity different from that of the antigen binding domain.

(A51) The polypeptide according to (A49) or (A50), wherein the second antigen binding domain comprises a second single-domain antibody.

(A52) The polypeptide according to (A51), wherein the antigen binding domain is a single-domain antibody, the second antigen binding domain is a second single-domain antibody, and the antigen binding domain and the second antigen binding domain are capable of being released from the polypeptide, wherein the single-domain antibody and the second single-domain antibody form a bispecific antigen binding molecule in released states of the antigen binding domain and the second antigen binding domain.

(A53) The polypeptide according to any one of (A49) to (A52), wherein the second antigen binding domain is directed to HER2, GPC3, ADAMTS4, ADAMTS5, IL1R1, BMP7, TGFb1, NGF or FGF18 as a target antigen.

(A54) The polypeptide according to any one of (A49) to (A53), wherein the antigen binding activity of the second antigen binding domain is also inhibited by linking to the carrying moiety of the polypeptide or without linking to the carrying moiety of the polypeptide.

(A55) The polypeptide according to any one of (A1) to (A54), wherein the polypeptide further has an additional antigen binding domain different from the antigen binding domain, wherein the antigen binding activity of the additional antigen binding domain is also inhibited by linking to the carrying moiety of the polypeptide.

(A56) The polypeptide according to (A55), wherein the additional antigen binding domain and the antigen binding domain differ in antigen binding specificity.

(A57) A pharmaceutical composition comprising a polypeptide according to any one of (A1) to (A56).

The present invention further encompasses exemplary embodiments described below.

(B1) A method for treating a subject having an Aggrecan mediated disease or disorder comprising administering to the subject an effective amount of the polypeptide of any one of (A1) to (A56).

(B2) A method for treating a subject having osteoarthritis (OA) comprising administering to the subject an effective amount of the polypeptide of any one of (A1) to (A56).

(B3) A method for preventing cartilage degradation of a subject in osteoarthritis (OA) comprising administering to the subject an effective amount of the polypeptide of any one of (A1) to (A56).

(B4) A pharmaceutical composition for treating a subject having an Aggrecan mediated disease or disorder, comprising an effective amount of the polypeptide of any one of (A1) to (A56).

(B5) A pharmaceutical composition for treating a subject having osteoarthritis (OA), comprising an effective amount of the polypeptide of any one of (A1) to (A56).

(B6) A pharmaceutical composition for preventing cartilage degradation of a subject in osteoarthritis (OA), comprising an effective amount of the polypeptide of any one of (A1) to (A56).

(B7) Use of the polypeptide of any one of (A1) to (A56) in a manufacture of a medicament for treating a subject having an Aggrecan mediated disease or disorder.

(B8) Use of the polypeptide of any one of (A1) to (A56) in a manufacture of a medicament for treating a subject having osteoarthritis (OA).

(B9) Use of the polypeptide of any one of (A1) to (A56) in a manufacture of a medicament for preventing cartilage degradation of a subject in osteoarthritis (OA).

(B10) A polypeptide of any one of (A1) to (A56) for use in treating a subject having an Aggrecan mediated disease or disorder.

(B11) A polypeptide of any one of (A1) to (A56) for use in treating a subject having osteoarthritis (OA).

(B12) A polypeptide of any one of (A1) to (A56) for use in preventing cartilage degradation of a subject in osteoarthritis (OA).

The present invention further encompasses exemplary embodiments described below.

(C1) A method for producing the polypeptide of any one of (A1) to (A56).

(C2) The production method according to (C1), comprising the following steps:
(a) obtaining an antigen binding domain binding to one or more antigens present in a cartilage tissue;
(b) linking the antigen binding domain obtained in the step (a) to a carrying moiety such that the antigen binding activity of the antigen binding domain is inhibited by an inhibiting domain of the carrying moiety, to form a polypeptide precursor; and
(c) introducing a protease cleavage sequence into the polypeptide precursor.

(C3) The production method according to (C1), comprising the following steps:
(a) obtaining an antigen binding domain binding to one or more antigens present in a cartilage tissue;
(b) linking the antigen binding domain obtained in the step (a) to a carrying moiety such that the antigen binding activity of the antigen binding domain is inhibited by an inhibiting domain of the carrying moiety, to form a polypeptide precursor; and
(c) introducing a protease cleavage sequence to near the boundary between the antigen binding domain and the carrying moiety.

(C4) The production method according to (C1), comprising the following steps:
(a) obtaining an antigen binding domain binding to one or more antigens present in a cartilage tissue; and
(b) linking the antigen binding domain obtained in the step (a) to a carrying moiety via a protease cleavage sequence such that the antigen binding activity of the antigen binding domain is inhibited by an inhibiting domain of the carrying moiety, to form a polypeptide.

(C5) The production method according to any one of (C2) to (C4), further comprising the following step:
(d) confirming that the binding activity of the antigen binding domain incorporated in the polypeptide or the polypeptide precursor against the target antigen is weakened or lost.

(C6) The production method according to any one of (C2) to (C5), further comprising the following step:
(e) releasing the antigen binding domain by cleaving the protease cleavage sequence with a protease and confirming that the released antigen binding domain binds to the antigen.

(C7) The production method according to (C1), wherein the polypeptide is an IgG antibody-like molecule.

(C8) The production method according to (C7), comprising the following steps:
(a) obtaining an antigen binding domain binding to one or more antigens present in a cartilage tissue;
(b) associating the antigen binding domain obtained in the step (a) as a substitute for VH of an IgG antibody or a modified IgG antibody with VL or VH, or associating the antigen binding domain as a substitute for VL of an IgG antibody or a modified IgG antibody with VH or VL such that the antigen binding activity of the antigen binding domain is inhibited, to form an IgG antibody-like molecule precursor harboring the antigen binding domain; and
(c) introducing a protease cleavage sequence into the IgG antibody-like molecule precursor harboring the antigen binding domain.

(C9) The production method according to (C7), comprising the following steps:
(a) obtaining an antigen binding domain binding to one or more antigens present in a cartilage tissue;
(b) associating the antigen binding domain obtained in the step (a) as a substitute for VH of an IgG antibody or a modified IgG antibody with VL or VH, or associating the antigen binding domain as a substitute for VL of an IgG antibody or a modified IgG antibody with VH or VL such that the antigen binding activity of the antigen binding domain is inhibited, to form an IgG antibody-like molecule precursor harboring the antigen binding domain; and
(c) introducing a protease cleavage sequence to near the boundary between the antigen binding domain and an antibody constant region in the IgG antibody-like molecule precursor.

(C10) The production method according to (C7), comprising the following steps:
(a) obtaining an antigen binding domain binding to one or more antigens present in a cartilage tissue; and
(b) linking the antigen binding domain obtained in the step (a) as a substitute for IgG antibody VH or VL to an IgG antibody heavy chain constant region or light chain constant region via a protease cleavage sequence such that the antigen binding activity of the antigen binding domain is inhibited, to form an IgG antibody-like molecule harboring the antigen binding domain.

(C11) The production method according to any one of (C8) to (C10), further comprising the following step:
(d) confirming that the binding activity of the antigen binding domain introduced in the IgG antibody-like molecule or the IgG antibody-like molecule precursor against the target antigen is weakened or lost.

(C12) The production method according to any one of (C8) to (C11), further comprising the following step:
(e) releasing the antigen binding domain by cleaving the protease cleavage sequence with a protease and confirming that the released antigen binding domain binds to the target antigen.

(C13) The production method according to (C7), comprising the following steps:
(a) substituting an amino acid residue in an antigen binding domain that involves in association of the antigen binding domain with antibody VH, or substituting an amino acid residue in an antigen binding domain that involves in association of the antigen binding domain with antibody VL, to prepare an antigen binding domain variant retaining the binding activity of the antigen binding domain against the target antigen;
(b) associating the antigen binding domain variant prepared in the step (a) with the antibody VH, or associating the antigen binding domain variant with the antibody VL such that the antigen binding activity of the antigen binding domain variant is inhibited, to form an IgG antibody-like molecule precursor harboring the antigen binding domain variant; and
(c) introducing a protease cleavage sequence into the IgG antibody-like molecule precursor harboring the antigen binding domain variant, wherein the antigen biding domain binds to one or more antigens present in a cartilage tissue.

(C14) The production method according to (C7), comprising the following steps:
(a) substituting an amino acid residue in an antigen binding domain that involves in association of the antigen binding domain with antibody VH, or substituting an amino acid residue in an antigen binding domain that involves in association of the antigen binding domain with antibody VL, to prepare an antigen binding domain variant retaining the binding activity of the antigen binding domain against the target antigen;
(b) associating the antigen binding domain variant prepared in the step (a) with the antibody VH, or associating the antigen binding domain variant with the antibody VL such that the antigen binding activity of the antigen binding domain variant is inhibited, to form an IgG antibody-like molecule precursor harboring the antigen binding domain variant; and (c) introducing a protease cleavage sequence to near the boundary between the antigen binding domain variant and a constant region in the IgG antibody-like molecule precursor, wherein the antigen biding domain binds to one or more antigens present in a cartilage tissue.

(C15) The production method according to (C7), comprising the following steps:

(a) substituting an amino acid residue in an antigen binding domain that involves in association of the antigen binding domain with antibody VH, or substituting an amino acid residue in an antigen binding domain that involves in association of the antigen binding domain with antibody VL, to prepare an antigen binding domain variant retaining the binding activity of the antigen binding domain against the target antigen; and (b) linking the antigen binding domain variant prepared in the step (a) to an IgG antibody heavy chain constant region via a protease cleavage sequence, or linking the antigen binding domain variant to an IgG antibody light chain constant region via a protease cleavage sequence such that the antigen binding activity of the antigen binding domain variant is inhibited, to form an IgG antibody-like molecule harboring the antigen binding domain variant, wherein the antigen biding domain binds to one or more antigens present in a cartilage tissue.

(C16) The production method according to any one of (C13) to (C15), further comprising the following step:

(d) confirming that the binding activity of the antigen binding domain variant harbored in the IgG antibody-like molecule or the binding activity of the antigen binding domain variant harbored in the IgG antibody-like molecule precursor against the target antigen is weakened or lost.

(C17) The production method according to any one of (C13) to (C16), further comprising the following step:

(e) releasing the antigen binding domain variant by cleaving the protease cleavage sequence with a protease and confirming that the released antigen binding domain variant binds to the target antigen.

(C18) The production method according to any one of (C2) to (C17), wherein the antigen binding domain binds to an epitope within one or more antigens present in a cartilage tissue.

(C19) The production method according to any one of (C1) to (C18), wherein the half-life of said one or more antigens in the cartilage tissue is 1 month or more.

(C20) The production method according to any one of (C1) to (C19), wherein the relative amount (% wet weight) of said one or more antigens in the cartilage tissue is 8% or more.

(C21) The production method according to any one of (C1) to (C20), wherein said one or more antigens are components of extracellular matrix of the cartilage tissue.

(C22) The production method according to any one of (C1) to (C21), wherein said one or more antigens are selected from the group consisting of aggrecan and/or collagen.

(C23) The production method according to any one of (C2) to (C22), wherein the antigen binding domain competes for binding the epitope with an antibody selected from the group consisting of:
1) MAB1220 (R&D SYSTEMS, Monoclonal Mouse IgG2B Clone #179509);
2) An antibody comprising VH sequence of SEQ ID NO: 512 and VL sequence of SEQ ID NO: 513;
3) An antibody comprising VH sequence of SEQ ID NO: 514 and VL sequence of SEQ ID NO: 515; and
4) An antibody comprising VH sequence of SEQ ID NO: 516 and VL sequence of SEQ ID NO: 517.

(C24) The production method according to any one of (C1) to (C23), wherein the antigen binding domain binds to an epitope selected from the group consisting of 1)-6) below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

(C25) The production method according to any one of (C2) to (C24), wherein the antigen binding domain comprises a single-domain antibody or an antagonist or is a single-domain antibody or an antagonist, (C26) The production method according to (C25), wherein the single-domain antibody is a VL having antigen binding activity by itself.

(C27) A polynucleotide encoding the polypeptide according to any one of (A1) to (A56).

(C28) A vector comprising the polynucleotide according to (C27).

(C29) A host cell comprising the polynucleotide according to (C27) or the vector according to (C28).

(C30) A method for producing the polypeptide of any one of (A1) to (A56), comprising the step of culturing the host cell according to (C29).

(C31) The polypeptide produced by the method according to any one of (C1) to (C26) and (C30).

The present invention further encompasses exemplary embodiments described below.

(D1) A method for screening for an antigen binding domain whose antigen binding activity can be inhibited by associating with particular VL, associating with particular VH, or associating with particular VHH, wherein the antigen is one or more molecules present in a cartilage tissue.

(D2) The screening method according to (D1), wherein the method is a method for screening for an antigen binding domain whose antigen binding activity can be inhibited by associating with particular VL.

(D3) The screening method according to (D2), comprising the following steps:

(a) obtaining an antigen binding domain having target antigen binding activity;

(b) associating the antigen binding domain obtained in the step (a) with a particular VL; and (c) confirming that the binding activity of the antigen binding domain associated with the particular VL in the step (b) against the antigen is weakened or lost as compared with that before the association.

(D4) The screening method according to (D2), comprising the following steps:
- (a) associating an antigen binding domain with a particular VL;
- (b) selecting an association of the VL and the antigen binding domain on the basis that the antigen binding domain associated with the particular VL in the step (a) has no binding activity or binding activity of a predetermined value or lower against the antigen; and
- (c) confirming that the antigen binding domain in the associate selected in the step (b) has stronger binding activity against the antigen in a state unassociated with the particular VL than that in a state associated therewith.

(D5) The screening method according to (D1), wherein the method is a method for screening for an antigen binding domain whose antigen binding activity can be inhibited by associating with particular VH.

(D6) The screening method according to (D5), comprising the following steps:
- (a) obtaining an antigen binding domain having target antigen binding activity;
- (b) associating the antigen binding domain obtained in the step (a) with a particular VH; and
- (c) confirming that the binding activity of the antigen binding domain associated with the particular VH in the step (b) against the antigen is weakened or lost as compared with that before the association.

(D7) The screening method according to (D5), comprising the following steps:
- (a) associating an antigen binding domain with a particular VH;
- (b) selecting an association of the VH and the antigen binding domain on the basis that the antigen binding domain associated with the particular VH in the step (a) has no binding activity or binding activity of a predetermined value or lower against the antigen; and
- (c) confirming that the antigen binding domain in the associate selected in the step (b) has stronger binding activity against the antigen in a state unassociated with the particular VH than that in a state associated therewith.

(D8) The screening method according to (D1), wherein the method is a method for screening for an antigen binding domain whose antigen binding activity can be inhibited by associating with particular VHH.

(D9) The screening method according to (D8), comprising the following steps:
- (a) obtaining an antigen binding domain having target antigen binding activity;
- (b) associating the antigen binding domain obtained in the step (a) with a particular VHH; and
- (c) confirming that the binding activity of the antigen binding domain associated with the particular VHH in the step (b) against the antigen is weakened or lost as compared with that before the association.

(D10) The screening method according to (D8), comprising the following steps:
- (a) associating an antigen binding domain with a particular VHH;
- (b) selecting an association of the VHH and the antigen binding domain on the basis that the antigen binding domain associated with the particular VHH in the step (a) has no binding activity or binding activity of a predetermined value or lower against the antigen; and
- (c) confirming that the antigen binding domain in the associate selected in the step (b) has stronger binding activity against the antigen in a state unassociated with the particular VHH than that in a state associated therewith.

(D11) The screening method according to any one of (D1) to (D10), wherein the antigen binding domain comprises a single-domain antibody or an antagonist or is a single-domain antibody or an antagonist.

(D12) The screening method according to (D11), wherein the single-domain antibody is a VL having antigen binding activity by itself.

(D13) The screening method according to any one of (D1) to (D12), wherein the half-life of said one or more antigens in the cartilage tissue is 1 month or more.

(D14) The screening method according to any one of (D1) to (D13), wherein the relative amount (% wet weight) of said one or more antigens in the cartilage tissue is 8% or more.

(D15) The screening method according to any one of (D1) to (D14), wherein said one or more antigens are components of extracellular matrix of the cartilage tissue.

(D16) The screening method according to any one of (D1) to (D15), wherein said one or more molecules are selected from the group consisting of aggrecan and/or collagen.

(D17) The screening method according to any one of (D1) to (D16), wherein the antigen binding domain competes for binding the epitope with an antibody selected from the group consisting of:
1) MAB1220 (R&D SYSTEMS, Monoclonal Mouse IgG2B Clone #179509);
2) An antibody comprising VH sequence of SEQ ID NO: 512 and VL sequence of SEQ ID NO: 513;
3) An antibody comprising VH sequence of SEQ ID NO: 514 and VL sequence of SEQ ID NO: 515; and
4) An antibody comprising VH sequence of SEQ ID NO: 516 and VL sequence of SEQ ID NO: 517.

(D18) The screening method according to any one of (D1) to (D17), wherein the antigen binding domain binds to an epitope selected from the group consisting of 1)-6) below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

(D19) The screening method according to any one of (D1) to (D18) for use in obtaining a candidate for
(i) treating a subject having an Aggrecan mediated disease or disorder,
(ii) treating a subject having osteoarthritis (OA), and/or
(iii) preventing cartilage degradation of a subject in osteoarthritis (OA).

The present invention further encompasses exemplary embodiments described below.

(E1) A method for producing an antigen binding domain whose antigen binding activity can be inhibited by associating with particular VL, associating with particular VH, or associating with particular VHH, wherein the antigen is one or more molecules present in a cartilage tissue.

(E2) The production method according to (E1), wherein the method is a method for producing an antigen binding domain whose antigen binding activity can be inhibited by associating with particular VL.

(E3) The production method according to (E2), comprising the following step:
(a) substituting an amino acid residue in an antigen binding domain that involves in association of the antigen binding domain with antibody VL, to prepare an antigen binding domain variant retaining the binding activity of the antigen binding domain against the target antigen.

(E4) The production method according to (E3), further comprising the following steps:
(b) associating the antigen binding domain variant prepared in the step (a) with the VL; and
(c) confirming that the antigen binding activity of the antigen binding domain variant associated with the VL is weakened or lost as compared with that before the association.

(E5) The production method according to (E1), wherein the method is a method for producing an antigen binding domain whose antigen binding activity can be inhibited by associating with particular VH.

(E6) The production method according to (E5), comprising the following step:
(a) substituting an amino acid residue in an antigen binding domain that involves in association of the antigen binding domain with antibody VH, to prepare an antigen binding domain variant retaining the binding activity of the antigen binding domain against the target antigen.

(E7) The production method according to (E6), further comprising the following steps:
(b) associating the antigen binding domain variant prepared in the step (a) with the VH; and
(c) confirming that the antigen binding activity of the antigen binding domain variant associated with the VH is weakened or lost as compared with that before the association.

(E8) The production method according to (E1), wherein the method is a method for producing an antigen binding domain whose antigen binding activity can be inhibited by associating with particular VHH.

(E9) The production method according to (E8), comprising the following step:
(a) substituting an amino acid residue in an antigen binding domain that involves in association of the antigen binding domain with an VHH, to prepare an antigen binding domain variant retaining the binding activity of the antigen binding domain against the target antigen.

(E10) The production method according to (E9), further comprising the following steps:
(b) associating the antigen binding domain variant prepared in the step (a) with the VHH; and
(c) confirming that the antigen binding activity of the antigen binding domain variant associated with the VHH is weakened or lost as compared with that before the association.

(E11) The production method according to any one of (E1) to (E10), wherein the antigen binding domain comprises a single-domain antibody or an antagonist or is a single-domain antibody or an antagonist.

(E12) The production method according to (E11), wherein the single-domain antibody is a VL having antigen binding activity by itself.

(E13) The production method according to any one of (E1) to (E12), wherein the half-life of said one or more antigens in the cartilage tissue is 1 month or more.

(E14) The production method according to any one of (E1) to (E13), wherein the relative amount (% wet weight) of said one or more antigens in the cartilage tissue is 8% or more.

(E15) The production method according to any one of (E1) to (E14), wherein said one or more antigens are components of extracellular matrix of the cartilage tissue.

(E16) The production method according to any one of (E1) to (E15), wherein said one or more molecules are selected from the group consisting of aggrecan and/or collagen.

(E17) The production method according to any one of (E1) to (E16), wherein the antigen binding domain competes for binding the epitope with an antibody selected from the group consisting of:
1) MAB1220 (R&D SYSTEMS, Monoclonal Mouse IgG2B Clone #179509);
2) An antibody comprising VH sequence of SEQ ID NO: 512 and VL sequence of SEQ ID NO: 513;
3) An antibody comprising VH sequence of SEQ ID NO: 514 and VL sequence of SEQ ID NO: 515; and
4) An antibody comprising VH sequence of SEQ ID NO: 516 and VL sequence of SEQ ID NO: 517.

(E18) The production method according to any one of (E1) to (E17), wherein the antigen binding domain binds to an epitope selected from the group consisting of 1) -6) below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

The present invention further encompasses exemplary embodiments described below.

(F1) A library comprising a plurality of fusion polypeptides of antigen binding domains each linked to a first association sustaining domain, wherein the antigen binding domains include an antigen binding domain whose antigen binding activity can be inhibited or could be lost by associating with particular VL, an antigen binding domain whose antigen binding activity can be inhibited or could be lost by associating with particular VH, or an antigen binding domain whose antigen binding activity can be inhibited or could be lost by associating with particular VHH, wherein the antigen is one or more molecules present in a cartilage tissue.

(F2) The library according to (F1), wherein the antigen binding domain comprises a single-domain antibody or is a single-domain antibody, and the single-domain antibody moieties of the fusion polypeptides in the library include a single-domain antibody obtained from an animal of the family Camelidae or a transgenic animal harboring a gene capable of raising the single-domain antibody, or a humanized antibody thereof, a single-domain antibody obtained by the immunization of an animal of the family Camelidae or a transgenic animal harboring a gene capable of raising the single-domain antibody, or a humanized antibody thereof, or an artificially prepared single-domain antibody originating from human antibody VH or VL.

(F3) The library according to (F1) or (F2) which is a library comprising a plurality of fusion polypeptides of antigen binding domains each linked to a first association sustaining domain, wherein the antigen binding domains include an antigen binding domain whose antigen binding activity can be inhibited or could be lost by associating with particular VL.

(F4) The library according to (F1) or (F2) which is a library comprising a plurality of fusion polypeptides of antigen binding domains each linked to a first association sustaining domain, wherein the antigen binding domains include an antigen binding domain whose antigen binding activity can be inhibited or could be lost by associating with particular VH.

(F5) The library according to (F1) or (F2) which is a library comprising a plurality of fusion polypeptides of antigen binding domains each linked to a first association sustaining domain, wherein the antigen binding domains include an antigen binding domain whose antigen binding activity can be inhibited or could be lost by associating with particular VHH.

(F6) The library according to any one of (F1) to (F5), wherein the first association sustaining domain comprises an IgG antibody CH1 domain or an antibody light chain constant region.

(F7) The library according to any one of (F1) to (F6), wherein the antigen binding domain comprises a single-domain antibody or an antagonist or is a single-domain antibody or an antagonist.

(F8) The library according to (F7), wherein the single-domain antibody is a VL having antigen binding activity by itself.

(F9) The library according to any one of (F1) to (F8), wherein the half-life of said one or more antigens in the cartilage tissue is 1 month or more.

(F10) The library according to any one of (F1) to (F9), wherein the relative amount (% wet weight) of said one or more antigens in the cartilage tissue is 8% or more.

(F11) The library according to any one of (F1) to (F10), wherein said one or more antigens are components of extracellular matrix of the cartilage tissue.

(F12) The library according to any one of (F1) to (F11), wherein said one or more molecules are selected from the group consisting of aggrecan and/or collagen.

(F13) The library according to any one of (F1) to (F12), wherein the antigen binding domain competes for binding the epitope with an antibody selected from the group consisting of:
1) MAB1220 (R&D SYSTEMS, Monoclonal Mouse IgG2B Clone #179509);
2) An antibody comprising VH sequence of SEQ ID NO: 512 and VL sequence of SEQ ID NO: 513;
3) An antibody comprising VH sequence of SEQ ID NO: 514 and VL sequence of SEQ ID NO: 515; and
4) An antibody comprising VH sequence of SEQ ID NO: 516 and VL sequence of SEQ ID NO: 517.

(F14) The library according to any one of (F1) to (F13), wherein the antigen binding domain binds to an epitope selected from the group consisting of 1)-6) below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

The present invention further encompasses exemplary embodiments described below.

(G1) A method for screening a library according to (F1) or (F2) for a fusion polypeptide comprising an antigen binding domain whose antigen binding activity can be inhibited or could be lost by associating with particular VL, an antigen binding domain whose antigen binding activity can be inhibited or could be lost by associating with particular VH, or an antigen binding domain whose antigen binding activity can be inhibited or could be lost by associating with particular VHH, wherein the antigen is one or more molecules present in a cartilage tissue.

(G2) A method for screening a library according to (F3) for a fusion polypeptide comprising an antigen binding domain whose antigen binding activity can be inhibited or could be lost by associating with particular VL, wherein the antigen is one or more molecules present in a cartilage tissue.

(G3) The screening method according to (G2), comprising the following steps:
(a) in vitro displaying the fusion polypeptides of the library;
(b) providing an association partner of a second association sustaining domain fused with a particular VL;
(c) associating the fusion polypeptides displayed in the step (a) with the association partner provided in the step (b) and selecting a fusion polypeptide that does not bind to the antigen or has antigen binding activity of a predetermined value or lower in a state where the antigen binding domain associates with the VL; and
(d) selecting, from the fusion polypeptides thus selected in the step (c), a fusion polypeptide that binds to the antigen or has antigen binding activity of a predetermined value or higher in a state where the antigen binding domain contained therein does not associate with the VL.

(G4) The screening method according to (G3), wherein the association partner provided in the step (b) further comprises a protease cleavage sequence, and the step (d) comprises cleaving the association partner by protease treatment so that the association of the antigen binding domain with the VL is canceled.

(G5) The screening method according to (G4), wherein the protease cleavage sequence of the association partner provided in the step (b) is located near the boundary between the particular VL and the second association sustaining domain.

(G6) The screening method according to (G3), wherein the fusion polypeptides of the library further comprise a protease cleavage sequence, and the step (d) comprises cleaving the fusion polypeptides by protease treatment so that the association of the antigen binding domain with the VL is canceled.

(G7) The screening method according to (G6), wherein the fusion polypeptide comprises a first association sustaining domain, and the protease cleavage sequence contained in each fusion polypeptide is located near the boundary between the antigen binding domain and the first association sustaining domain.

(G8) The screening method according to (G3), wherein the step (d) comprises in vitro displaying again the full lengths of the fusion polypeptides selected in the step (c) or their moieties comprising the antigen binding domains.

(G9) The screening method according to (G3), wherein the step (d) comprises in vitro displaying again the full lengths of the fusion polypeptides selected in the step (c) and selecting a fusion polypeptide that binds to the antigen or has antigen binding activity of a predetermined value or higher in a state associated only with the second association sustaining domain.

(G10) A method for screening a library according to (F4) for a fusion polypeptide comprising an antigen binding domain whose antigen binding activity can be inhibited or could be lost by associating with particular VH, wherein the antigen is one or more molecules present in a cartilage tissue.

(G11) The screening method according to (G10), comprising the following steps:
  (a) in vitro displaying the fusion polypeptides of the library;
  (b) providing an association partner of a second association sustaining domain fused with a particular VH;
  (c) associating the fusion polypeptides displayed in the step (a) with the association partner provided in the step (b) and selecting a fusion polypeptide that does not bind to the antigen or has antigen binding activity of a predetermined value or lower in a state where the antigen binding domain associates with the VH; and
  (d) selecting, from the fusion polypeptides thus selected in the step (c), a fusion polypeptide that binds to the antigen or has antigen binding activity of a predetermined value or higher in a state where the antigen binding domain contained therein does not associate with the VH.

(G12) The screening method according to (G11), wherein the association partner provided in the step (b) further comprises a protease cleavage sequence, and the step (d) comprises cleaving the association partner by protease treatment so that the association of the antigen binding domain with the VH is canceled.

(G13) The screening method according to (G12), wherein the protease cleavage sequence of the association partner provided in the step (b) is located near the boundary between the particular VH and the second association sustaining domain.

(G14) The screening method according to (G11), wherein the fusion polypeptides of the library further comprise a protease cleavage sequence, and the step (d) comprises cleaving the fusion polypeptides by protease treatment so that the association of the antigen binding domain with the VH is canceled.

(G15) The screening method according to (G14), wherein the fusion polypeptide comprises a first association sustaining domain, and the protease cleavage sequence contained in each fusion polypeptide is located near the boundary between the antigen binding domain and the first association sustaining domain.

(G16) The screening method according to (G11), wherein the step (d) comprises in vitro displaying again the full lengths of the fusion polypeptides selected in the step (c) or their moieties comprising the antigen binding domains.

(G17) The screening method according to (G11), wherein the step (d) comprises in vitro displaying again the full lengths of the fusion polypeptides selected in the step (c) and selecting a fusion polypeptide that binds to the antigen or has antigen binding activity of a predetermined value or higher in a state associated only with the second association sustaining domain.

(G18) A method for screening a library according to (F5) for a fusion polypeptide comprising an antigen binding domain whose antigen binding activity can be inhibited or could be lost by associating with particular VHH, wherein the antigen is one or more molecules present in a cartilage tissue.

(G19) The screening method according to (G18), comprising the following steps:
  (a) in vitro displaying the fusion polypeptides of the library;
  (b) providing an association partner of a second association sustaining domain fused with a particular VHH;
  (c) associating the fusion polypeptides displayed in the step (a) with the association partner provided in the step (b) and selecting a fusion polypeptide that does not bind to the antigen or has antigen binding activity of a predetermined value or lower in a state where the antigen binding domain associates with the particular VHH; and
  (d) selecting, from the fusion polypeptides thus selected in the step (c), a fusion polypeptide that binds to the antigen or has antigen binding activity of a predetermined value or higher in a state where the antigen binding domain contained therein does not associate with the VHH.

(G20) The screening method according to (G19), wherein the association partner provided in the step (b) further comprises a protease cleavage sequence, and the step (d) comprises cleaving the association partner by protease treatment so that the association of the antigen binding domain with the VHH is canceled.

(G21) The screening method according to (G20), wherein the protease cleavage sequence of the association partner provided in the step (b) is located near the boundary between the particular VHH and the second association sustaining domain.

(G22) The screening method according to (G19), wherein the fusion polypeptides of the library further comprise a protease cleavage sequence, and the step (d) comprises cleaving the fusion polypeptides by protease treatment so that the association of the antigen binding domain with the VHH is canceled.

(G23) The screening method according to (G22), wherein the fusion polypeptide comprises a first association sustaining domain, and the protease cleavage sequence contained in each fusion polypeptide is located near the boundary between the antigen binding domain and the first association sustaining domain.

(G24) The screening method according to (G19), wherein the step (d) comprises in vitro displaying again the full lengths of the fusion polypeptides selected in the step (c) or their moieties comprising the antigen binding domains.

(G25) The screening method according to (G19), wherein the step (d) comprises in vitro displaying again the full lengths of the fusion polypeptides selected in the step (c) and selecting a fusion polypeptide that binds to the antigen or has antigen binding activity of a predetermined value or higher in a state associated only with the second association sustaining domain.

(G26) The screening method according to any one of (G3) to (G9), (G11) to (G17), and (G19) to (G25), wherein the step of providing an association partner in the step (b) is the step of displaying the association partner and the fusion polypeptides together.

(G27) The screening method according to any one of (G7) to (G9), (G15) to (G17), and (G23) to (G25), wherein the first association sustaining domain comprises an IgG antibody CH1 domain or an antibody light chain constant region.

(G28) The screening method according to any one of (G3) to (G9), (G11) to (G17), and (G19) to (G25), wherein the second association sustaining domain comprises an IgG antibody CH1 domain or an antibody light chain constant region.

(G29) The screening method according to (G27) or (G28), wherein the first association sustaining domain comprises an IgG antibody CH1 domain, and the second association sustaining domain comprises an antibody light chain constant region.

(G30) The screening method according to (G27) or (G28), wherein the first association sustaining domain comprises an antibody light chain constant region, and the second association sustaining domain comprises an IgG antibody CH1 domain.

(G31) The screening method according to (G2), comprising the following steps:
- (a) in vitro displaying the fusion polypeptides of the library;
- (b) providing an association partner of a second association sustaining domain fused with a particular VL;
- (c) selecting a fusion polypeptide comprising an antigen binding domain that binds to the antigen or has antigen binding activity of a predetermined value or higher; and
- (d) associating the fusion polypeptides thus selected in the step (c) with the association partner provided in the step (b) and selecting a fusion polypeptide that does not bind to the antigen or has antigen binding activity of a predetermined value or lower in a state where the antigen binding domain associates with the VL.

(G32) The screening method according to (G31), wherein the step (d) comprises in vitro displaying again the fusion polypeptides selected in the step (c).

(G33) The screening method according to (G31), wherein the step (c) comprises associating the fusion polypeptide only with the second association sustaining domain or confirming the antigen binding of the antigen binding domain contained in the fusion polypeptide associated only with the second association sustaining domain.

(G34) The screening method according to (G10), comprising the following steps:
- (a) in vitro displaying the fusion polypeptides of the library;
- (b) providing an association partner of a second association sustaining domain fused with a particular VH;
- (c) selecting a fusion polypeptide comprising an antigen binding domain that binds to the antigen or has antigen binding activity of a predetermined value or higher; and
- (d) associating the fusion polypeptides thus selected in the step (c) with the association partner provided in the step (b) and selecting a fusion polypeptide that does not bind to the antigen or has antigen binding activity of a predetermined value or lower in a state where the antigen binding domain associates with the VH.

(G35) The screening method according to (G34), wherein the step (d) comprises in vitro displaying again the fusion polypeptides selected in the step (c).

(G36) The screening method according to (G34), wherein the step (c) comprises associating the fusion polypeptide only with the second association sustaining domain or confirming the antigen binding of the antigen binding domain contained in the fusion polypeptide associated only with the second association sustaining domain.

(G37) The screening method according to (G18), comprising the following steps:
- (a) in vitro displaying the fusion polypeptides of the library;
- (b) providing an association partner of a second association sustaining domain fused with a particular VHH;
- (c) selecting a fusion polypeptide comprising an antigen binding domain that binds to the antigen or has antigen binding activity of a predetermined value or higher; and
- (d) associating the fusion polypeptides thus selected in the step (c) with the association partner provided in the step (b) and selecting a fusion polypeptide that does not bind to the antigen or has antigen binding activity of a predetermined value or lower in a state where the antigen binding domain associates with the VHH.

(G38) The screening method according to (G37), wherein the step (d) comprises in vitro displaying again the fusion polypeptides selected in the step (c).

(G39) The screening method according to (G37), wherein the step (c) comprises associating the fusion polypeptide only with the second association sustaining domain or confirming the antigen binding of the antigen binding domain contained in the fusion polypeptide associated only with the second association sustaining domain.

(G40) The screening method according to any one of (G31) to (G39), wherein the fusion polypeptide comprises a first association sustaining domain, and the first association sustaining domain comprises an IgG antibody CH1 domain or an antibody light chain constant region.

(G41) The screening method according to any one of (G31) to (G40), wherein the second association sustaining domain comprises an IgG antibody CH1 domain or an antibody light chain constant region.

(G42) The screening method according to any one of (G31) to (G41), wherein the step of associating the fusion polypeptides with the association partner in the step (d) is the step of displaying the association partner and the fusion polypeptides together.

(G43) The screening method according to any one of (G31) to (G42), wherein the fusion polypeptide comprises a first association sustaining domain, and the first association sustaining domain comprises an IgG antibody CH1 domain, and the second association sustaining domain comprises an antibody light chain constant region.

(G44) The screening method according to any one of (G31) to (G42), wherein the fusion polypeptide comprises a first association sustaining domain, and the first association sustaining domain comprises an antibody light chain constant region, and the second association sustaining domain comprises an IgG antibody CH1 domain.

(G45) The screening method according to any one of (G31) to (G44), wherein the antigen binding domain comprises a single-domain antibody or antagonist or is a single-domain antibody or antagonist.

(G46) The screening method according to (G45), wherein the single-domain antibody is a VL having antigen binding activity by itself.

(G47) The screening method according to any one of (G1) to (G46), wherein the half-life of said one or more antigens in the cartilage tissue is 1 month or more.

(G48) The screening method according to any one of (G1) to (G47), wherein the relative amount (% wet weight) of said one or more antigens in the cartilage tissue is 8% or more.

(G49) The screening method according to any one of (G1) to (G48), wherein said one or more antigens are components of extracellular matrix of the cartilage tissue.

(G50) The screening method according to any one of (G1) to (G49), wherein said one or more molecules are selected from the group consisting of aggrecan and/or collagen.

(G51) The screening method according to any one of (G1) to (G50), wherein the antigen binding domain competes for binding the epitope with an antibody selected from the group consisting of:
1) MAB1220 (R&D SYSTEMS, Monoclonal Mouse IgG2B Clone #179509);
2) An antibody comprising VH sequence of SEQ ID NO: 512 and VL sequence of SEQ ID NO: 513;
3) An antibody comprising VH sequence of SEQ ID NO: 514 and VL sequence of SEQ ID NO: 515; and
4) An antibody comprising VH sequence of SEQ ID NO: 516 and VL sequence of SEQ ID NO: 517.

(G52) The screening method according to any one of (G1) to (G51), wherein the antigen binding domain binds to an epitope selected from the group consisting of 1)-6) below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

(H1) This item encompasses following embodiments in alternative manner:
(H1-1) An anti-Aggrecan antibody which competes for binding to Aggrecan with an antibody selected from the group consisting of:
1) An antibody comprising VH sequence of SEQ ID NO: 512 and VL sequence of SEQ ID NO: 513,
2) An antibody comprising VH sequence of SEQ ID NO: 514 and VL sequence of SEQ ID NO: 515, and
3) An antibody comprising VH sequence of SEQ ID NO: 516 and VL sequence of SEQ ID NO: 517.

(H1-2) An anti-Aggrecan antibody which binds to an epitope selected from the group consisting of 1)-2) below:
1) amino acids at positions 377-386 of the amino acid sequence set forth in SEQ ID NO: 509,
2) amino acids at positions 48-673 (G1-IGD-G2 Domain) of the amino acid sequence set forth in SEQ ID NO: 509.

(H2) This item encompasses following embodiments in alternative manner:
(H2-1) The antibody according to (H1), wherein the antigen binding domain comprises (a) a VH sequence having at least 95% sequence identity to the amino acid sequence of SEQ ID NO: 512 or 514 and/or (b) a VL sequence having at least 95% sequence identity to the amino acid sequence of SEQ ID NO: 513 or 515.

(H2-2) The antibody according to (H1), wherein the antigen binding domain comprises (a) a VH sequence having at least 95% sequence identity to the amino acid sequence of SEQ ID NO: 516 and/or (b) a VL sequence having at least 95% sequence identity to the amino acid sequence of SEQ ID NO: 517.

(H2-3) The antibody according to (H1), wherein the antigen binding domain comprises any one of the combinations of H-chain CDR1, CDR2, and CDR3 and L-chain CDR1, CDR2, and CDR3 selected from 1) to 3) below, or any one of the combinations of H-chain CDR1, CDR2, and CDR3 and L-chain CDR1, CDR2, and CDR3 of antibody variable regions functionally equivalent thereto:

1) H-chain CDR1, CDR2, and CDR3 comprised in the antibody variable region are identical to the amino acid sequences of the CDR1, CDR2, and CDR3 regions comprised in SEQ ID NO:512; and L-chain CDR1, CDR2, and CDR3 comprised in the antibody variable region are identical to the amino acid sequences of the CDR1, CDR2, and CDR3 regions comprised in SEQ ID NO:513;
2) H-chain CDR1, CDR2, and CDR3 comprised in the antibody variable region are identical to the amino acid sequences of the CDR1, CDR2, and CDR3 regions comprised in SEQ ID NO:514; and L-chain CDR1, CDR2, and CDR3 comprised in the antibody variable region are identical to the amino acid sequences of the CDR1, CDR2, and CDR3 regions comprised in SEQ ID NO:515; and
3) H-chain CDR1, CDR2, and CDR3 comprised in the antibody variable region are identical to the amino acid sequences of the CDR1, CDR2, and CDR3 regions comprised in SEQ ID NO:516; and L-chain CDR1, CDR2, and CDR3 comprised in the antibody variable region are identical to the amino acid sequences of the CDR1, CDR2, and CDR3 regions comprised in SEQ ID NO:517.

(H2-4) The antibody according to (H1), wherein the antigen binding domain comprises any one of the combinations of H-chain CDR1, CDR2, and CDR3 and L-chain CDR1, CDR2, and CDR3 of antibody variable regions selected from 1) to 3) below, or antibody variable regions functionally equivalent thereto:
1) An antibody H-chain variable region comprising the amino acid sequences of SEQ ID NO:512; and an antibody L-chain variable region comprising the amino acid sequences of SEQ ID NO:513;
2) An antibody H-chain variable region comprising the amino acid sequences of SEQ ID NO:514; and an antibody L-chain variable region comprising the amino acid sequences of SEQ ID NO:515; and
3) An antibody H-chain variable region comprising the amino acid sequences of SEQ ID NO:516; and an antibody L-chain variable region comprising the amino acid sequences of SEQ ID NO:517.

(H3) A pharmaceutical composition comprising the antibody according to (H1) or (H2).

(H4) This item encompasses following embodiments in alternative manner:
(H4-1) A method for treating an individual having an Aggrecan mediated disease or disorder comprising administering to the individual an effective amount of the antibody according to (H1) or (H2).
(H4-2) A method for treating an individual having osteoarthritis (OA) comprising administering to the individual an effective amount of the antibody according to (H1) or (H2).
(H4-3) A method for preventing cartilage degradation of an individual in osteoarthritis (OA) comprising administering to the individual an effective amount of the antibody according to (H1) or (H2).

(I1) An antibody which binds to a molecule present in a cartilage tissue, wherein the molecule is not a soluble antigen, wherein the molecular weight of the antibody is 120 kDa or smaller.

(I2) This item encompasses following embodiments in alternative manner:

(I2-1) The antibody according to (I1), wherein the molecular weight of the antibody is 100 kDa or smaller, 80 kDa or smaller, 60 kDa or smaller, 40 kDa or smaller, or 20 kDa or smaller.

(I2-2) The antibody according to (I1), wherein the antibody is F(ab')2, Fab, scFv, VHH, VL, VH or single domain antibody.

(I2-3) The antibody according to (I1), wherein the molecule present in a cartilage tissue is extracellular matrix in the cartilage tissue selected from the group consisting of:
1. collagen,
2. proteoglycan,
3. glycoprotein,
4. sugar chain, and
5. other proteins.

(I2-4) The antibody according to (I2-3), wherein collagen is selected from the group consisting of:
1-2. collagen except for Collagen type II
1-3. Firillar collagen
1-4. Disease non-modified collagen (I2-5) The antibody according to (I2-3), wherein collagen is selected from the group consisting of: Collagen type II(fibrillar collagen), Collagen type III (fibrillar collagen), Collagen type IV, Collagen type V(fibrillar collagen), Collagen type VI, Collagen type IX, Collagen type X, Collagen type XI(fibrillar collagen), Collagen type XII, Collagen type XIV, Collagen type XVI, Collagen type XXII, Collagen type XXIV(fibrillar collagen), and Collagen type XXVII (fibrillar collagen).

(I2-6) The antibody according to (I2-3), wherein proteoglycans selected from the group consisting of: Aggrecan, Vercican, Perlecan, Syndecan, Lubricin, Link protein, and Small leucine-rich repeat proteoglycans.

(I2-7) The antibody according to (I1), wherein the molecule is a protein linked with proteoglycans selected from the group consisting of: Aggrecan, Vercican, Perlecan, Syndecan, Lubricin.

(I2$^{-8}$) The antibody according to (I2-6), wherein Small leucine-rich repeat proteoglycans selected from the group consisting of: Decorin, Biglycan, Asporin, Fibromodulin, Lumican, Keratocan, Osteoadherin, Proline-/arginine-rich end leucine-rich repeat protein, Epiphycan, Mimecan, Opticin, Chondroadherin, and Chondroadherin-like.

(I2-9) The antibody according to (I2-3), wherein sugar chain is selected from the group consisting of: Hyaluronic acid (HA), Chondroitin sulfate (CS), Keratan sulfate (KS), and Dermatan sulfate (DS).

(I2-10) The antibody according to (I1), wherein the molecule present in a cartilage tissue is extracellular matrix in the cartilage tissue selected from the group consisting of: Thrombospondin, Matrilin, WARP, UCMA, CILP, Fibronectin, Lamin, and Nidgen.

(I3) The antibody according to (I1) or (I2), wherein the molecule is a membrane antigen or an Extracellular matrix in the cartilage tissue.

(I4) The antibody according to any one of (I1) to (I3), wherein the half-life of the molecule in the cartilage tissue is 1 month or more, 2 month or more, 6 month or more, 1 year or more, or 5 year or more.

(I5) The antibody according to any one of (I1) to (I3), wherein the relative amount (% wet weight) of the molecule in the cartilage tissue is 1% or more, 2% or more, 3% or more, 4% or more, 5% or more, 10% or more, 15% or more, or 20% or more.

(I6) The antibody according to any one of (I3) or (I5), wherein the molecule is an Extracellular matrix in the cartilage tissue, and wherein the Extracellular matrix is Aggrecan or Collagen.

(J1) A method for increasing penetration rate into a cartilage tissue of an antibody which binds to a molecule present in the cartilage issue, comprising modifying a parent antibody binding to the same molecule so as to decrease the molecular weight of the parent antibody while substantially maintaining or improving the binding ability to the molecule, wherein the molecule is not a soluble antigen.

(J2) The method according to (J1), wherein the parent antibody is a whole IgG type antibody.

(J3) This item encompasses following embodiments in alternative manner:

(J3-1) The method according to (J1), wherein the molecular weight of the antibody is 120 kDa or smaller, 100 kDa or smaller, 80 kDa or smaller, 60 kDa or smaller, 40 kDa or smaller, or 20 kDa or smaller.

(J3-2) The method according to (J1), wherein the antibody is F(ab')2, Fab, scFv, VHH, VL, VH or single domain antibody.

(J4) The method according to any one of (J1) to (J3), wherein the molecule is a membrane antigen or an Extracellular matrix in the cartilage tissue.

(J5) The method according to any one of (J1) to (J4), wherein the half-life of the molecule in the cartilage tissue is 1 month or more, 2 month or more, 6 month or more, 1 year or more, or 5 year or more.

(J6) The method according to any one of (J1) to (J5), wherein the relative amount (% wet weight) of the molecule in the cartilage tissue is 1% or more, 2% or more, 3% or more, 4% or more, 5% or more, 10% or more, 15% or more, or 20% or more.

(J7) The method according to any one of (J1) to (J6), wherein the molecule is an Extracellular matrix in the cartilage tissue, and wherein the Extracellular matrix in the cartilage tissue is Aggrecan or Collagen.

(K1) A method for producing an antibody having an increased penetration rate into a cartilage tissue, which binds to a molecule present in a cartilage tissue, comprising modifying a parent antibody binding to the same molecule so as to decrease the molecular weight of the parent antibody while substantially maintaining or improving the binding ability to the molecule, wherein the molecule is not a soluble antigen.

(K2) The method according to (K1), wherein the parent antibody is a whole IgG type antibody.

(K3) This item encompasses following embodiments in alternative manner:

(K3-1) The method according to (K2), wherein the molecular weight of the antibody is 120 kDa or smaller, 100 kDa smaller, 80 kDa or smaller, 60 kDa or smaller, 40 kDa or smaller, or 20 kDa or smaller.

(K3-2) The method according to (K2), wherein the antibody is F(ab')2, Fab, scFv, VHH, VL, VH or single domain antibody.

(K4) The method according to any one of (K1) to (K3), wherein the molecule is a membrane antigen or an Extracellular matrix in the cartilage tissue.

(K5) The method according to any one of (K1) or (K4), wherein the half-life of the molecule in the cartilage tissue is 1 month or more, 2 month or more, 6 month or more, 1 year or more, or 5 year or more.

(K6) The method according to any one of (K1) to (K5), wherein the relative amount (% wet weight) of the molecule in the cartilage tissue is 1% or more, 2% or more, 3% or more, 4% or more, 5% or more, 10% or more, 15% or more, or 20% or more.

(K7) The method according to any one of (K1) to (K6), wherein the molecule is an Extracellular matrix in the cartilage tissue, and wherein the Extracellular matrix in the cartilage tissue is Aggrecan or Collagen.

(L1) A method for increasing retention time in a cartilage tissue of an antibody which binds to a molecule present in the cartilage issue, comprising modifying a parent antibody binding to the same molecule so as to decrease the molecular weight of the parent antibody while substantially maintaining or improving the binding ability to the molecule, wherein the molecule is not a soluble antigen.

(L2) The method according to (L1), wherein the parent antibody is a whole IgG type antibody.

(L3) This item encompasses following embodiments in alternative manner:

(L3-1) The method according to (L2), wherein the molecular weight of the antibody is 120 kDa or smaller, 100 kDa or smaller, 80 kDa or smaller, 60 kDa or smaller, 40 kDa or smaller, or 20 kDa or smaller.

(L3-2) The method according to (L2), wherein the antibody is F(ab')2, Fab, scFv, VHH, VL, VH or single domain antibody.

(L4) The method according to any one of (L1) to (L3), wherein the molecule is a membrane antigen or an Extracellular matrix in the cartilage tissue.

(L5) The method according to any one of (L1) to (L4), wherein the half-life of the molecule in the cartilage tissue is 1 month or more, 2 month or more, 6 month or more, 1 year or more, or 5 year or more.

(L6) The method according to any one of (L1) to (L5), wherein the relative amount (% wet weight) of the molecule in the cartilage tissue is 1% or more, 2% or more, 3% or more, 4% or more, 5% or more, 10% or more, 15% or more, or 20% or more.

(L7) The method according to any one of (L1) to (L6), wherein the molecule is an Extracellular matrix in the cartilage tissue, and wherein the Extracellular matrix in the cartilage tissue is Aggrecan or Collagen.

(M1) A method for producing an antibody having an increased retention time in a cartilage tissue, which binds to a molecule present in the cartilage tissue, comprising modifying a parent antibody binding to the same molecule so as to decrease the molecular weight of the parent antibody while substantially maintaining or improving the binding ability to the same molecule, wherein the molecule is not a soluble antigen.

(M2) The method according to (M1), wherein the parent antibody is a whole IgG type antibody.

(M3) This item encompasses following embodiments in alternative manner:

(M3-1) The method according to (M1), wherein the molecular weight of the antibody is 120 kDa or smaller, 100 kDa or smaller, 80 kDa or smaller, 60 kDa or smaller, 40 kDa or smaller, or 20 kDa or smaller.

(M3-2) The method according to (M1), wherein the antibody is F(ab')2, Fab, scFv, VHH, VL, VH or single domain antibody.

(M4) The method according to any one of (M1) to (M3), wherein the molecule is a membrane antigen or an Extracellular matrix in the cartilage tissue.

(M5) The method according to any one of (M1) to (M4), wherein the half-life of the molecule in the cartilage tissue is 1 month or more, 2 month or more, 6 month or more, 1 year or more, or 5 year or more.

(M6) The method according to any one of (M1) to (M5), wherein the relative amount (% wet weight) of the molecule in the cartilage tissue is 1% or more, 2% or more, 3% or more, 4% or more, 5% or more, 10% or more, 15% or more, or 20% or more.

(M7) The method according to any one of (M1) to (M6), wherein the molecule is an Extracellular matrix in the cartilage tissue, and wherein the Extracellular matrix in the cartilage tissue is Aggrecan or Collagen.

(N1) A method for penetrating into and/or retaining in a cartilage tissue of an antibody, the method is characterized by using an antibody having an ability to bind to a molecule present in the cartilage tissue, wherein the antibody has the molecular weight less than that of a whole IgG type antibody, wherein the molecule is not a soluble antigen.

(N2) This item encompasses following embodiments in alternative manner:

(N2-1) The method according to (N1), wherein the molecular weight of the antibody is 120 kDa or smaller, 100 kDa or smaller, 80 kDa or smaller, 60 kDa or smaller, 40 kDa or smaller, or 20 kDa or smaller.

(N2-2) The method according to (N1), wherein the antibody is scaffold, F(ab')2, Fab, scFv, VHH, VL, VH or single domain antibody.

(N3) The method according to any one of (N1) to (N2), wherein the molecule is a membrane antigen or an Extracellular matrix in the cartilage tissue.

(N4) The method according to any one of (N1) to (N3), wherein the half-life of the molecule in the cartilage tissue is 1 month or more, 2 month or more, 6 month or more, 1 year or more, or 5 year or more.

(N5) The method according to any one of (N1) to (N4), wherein the relative amount (% wet weight) of the molecule in the cartilage tissue is 1% or more, 2% or more, 3% or more, 4% or more, 5% or more, 10% or more, 15% or more, or 20% or more.

(N6) The method according to any one of (N1) to (N5), wherein the molecule is an Extracellular matrix in the cartilage tissue, and wherein the Extracellular matrix in the cartilage tissue is Aggrecan or Collagen.

(O1) A polypeptide comprising:
  (a) an antibody which binds to a molecule present in a cartilage tissue, and
  (b) an antigen-binding domain which binds to a molecule present in the cartilage tissue, which is not the molecule that the antibody binds to.

(O2) The polypeptide according to (O1), wherein the antibody of (a) is an antibody that inhibits ADAMTS4/5 activity, NGF activity or IL1R1 activity, or enhances BMP7 agonist activity, TGFb1 agonist activity, or FGF18 agonist activity.

(O3) The polypeptide according to (O1) or (O2), wherein either or both of the molecule of (a) and/or the molecule of (b) is not a soluble antigen.

(O4) This item encompasses following embodiments in alternative manner: (O4-1) The polypeptide according to any one of (O1) to (O3), wherein the molecular weight of the antibody and/or the antigen-binding domain is 120 kDa or smaller, 100 kDa or smaller, 80 kDa or smaller, 60 kDa or smaller, 40 kDa or smaller, or 20 kDa or smaller.

(O4-2) The polypeptide according to any one of (O1) to (O3), wherein the antibody is whole IgG type antibody, scaffold, F(ab')2, Fab, scFv, VHH, VL, VH or single domain antibody.

(O5) The polypeptide according to (O1) or (O4), wherein the molecule of (a) and/or the molecule of (b) is a membrane antigen or an Extracellular matrix in the cartilage tissue.

(O6) The polypeptide according to any one of (O1) to (O5), wherein the half-life of the molecule in the cartilage tissue is 1 month or more, 2 month or more, 6 month or more, 1 year or more, or 5 year or more.

(O7) The polypeptide according to any one of (O1) to (O6), wherein the relative amount (% wet weight) of the molecule in the cartilage tissue is 1% or more, 2% or more, 3% or more, 4% or more, 5% or more, 10% or more, 15% or more, or 20% or more.

(O8) The polypeptide according to any one of (O5) or (O7), wherein the molecule of (a) and/or the molecule of (b) is an Extracellular matrix in the cartilage tissue, and wherein the Extracellular matrix in the cartilage tissue is Aggrecan or Collagen.

(O9) The polypeptide according to any one of (O1) to (O8), wherein the polypeptide further has an additional antigen binding domain different from the antigen binding domain.

(O10) The polypeptide according to any one of (O1) to (O9), wherein said polypeptide is also the polypeptide according to any of (A1) to (A56), and wherein either (i) an antigen binding domain of the antibody of (a) of the polypeptide of (O1) or (ii) the antigen binding domain of (b) of the polypeptide of (O1) is the antigen binding domain of the polypeptide of (A1).

The present invention also specifically encompasses the following embodiments.

(1) A polypeptide comprising an antigen binding domain and a carrying moiety, wherein the antigen binding domain has a shorter half-life in blood than that of the carrying moiety that has an inhibiting domain that inhibits the antigen binding activity of the antigen binding domain, and wherein the antigen is a molecule present in a cartilage tissue.

(2) The polypeptide according to (1), wherein the half-life of the molecule in the cartilage tissue is 1 month or more.

(3) The polypeptide according to (1) or (2), wherein the relative amount (% wet weight) of the molecule in the cartilage tissue is 8% or more.

(4) The polypeptide according to any one of (1) to (3), wherein the molecule is a component of extracellular matrix of the cartilage tissue.

(5) The polypeptide according to (4), wherein the component of extracellular matrix is Aggrecan or Collagen.

(6) The polypeptide according to (5), wherein the antigen binding domain binds to an epitope within Aggrecan, wherein the antigen binding domain competes for binding the epitope with an antibody selected from the group consisting of 1) below:

1) MAB1220 (R&D SYSTEMS, Monoclonal Mouse IgG2B Clone #179509).

(7) The polypeptide according to (5), wherein the antigen binding domain binds to an epitope within Aggrecan, wherein the antigen binding domain competes for binding the epitope with an antibody selected from the group consisting of 1)-3) below:

1) An antibody comprising VH sequence of SEQ ID NO: 512 and VL sequence of SEQ ID NO: 513,
2) An antibody comprising VH sequence of SEQ ID NO: 514 and VL sequence of SEQ ID NO: 515, and
3) An antibody comprising VH sequence of SEQ ID NO: 516 and VL sequence of SEQ ID NO: 517.

(8) The polypeptide according to (5), wherein the antigen binding domain binds to an epitope selected from the group consisting of 1) to 6) below:

1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

(9) The polypeptide according to any one of (1) to (8), wherein the molecular weight of the antigen binding domain is 120 kDa or smaller.

(10) An anti-Aggrecan antibody which competes for binding to Aggrecan with an antibody selected from the group consisting of:

1) An antibody comprising VH sequence of SEQ ID NO: 512 and VL sequence of SEQ ID NO: 513,
2) An antibody comprising VH sequence of SEQ ID NO: 514 and VL sequence of SEQ ID NO: 515, and
3) An antibody comprising VH sequence of SEQ ID NO: 516 and VL sequence of SEQ ID NO: 517.

(11) A pharmaceutical composition comprising the polypeptide according to any one of (1) to (9) or the antibody according to (10).

(12) A method for producing an antibody having an increased penetration rate into a cartilage tissue, which binds to a molecule present in a cartilage tissue, comprising modifying a parent antibody binding to the same molecule so as to decrease the molecular weight of the parent antibody while substantially maintaining the binding ability to the molecule, wherein the molecule is not a soluble antigen.

(13) A method for producing an antibody having an increased retention time in a cartilage tissue, which binds to a molecule present in the cartilage tissue, comprising modifying a parent antibody binding to the same molecule so as to decrease the molecular weight of the parent antibody while substantially maintaining the binding ability to the same molecule, wherein the molecule is not a soluble antigen.

(14) The method according to (12) or (13), wherein the parent antibody is a whole antibody.

(15) The method according to any one of (12) to (14), wherein the molecular weight of the antibody is 120 kDa or smaller.

BRIEF DESCRIPTION OF DRAWINGS

FIG. 1 is a diagram showing the concept of Probody technology. The Probody is an antibody molecule whose antigen binding activity is inhibited by connecting an antibody to a peptide masking the antigen binding site of the antibody via a linker that is cleaved by protease expressed at a lesion site.

FIG. 2 is a diagram showing a cause of adverse reactions that might be exhibited by Probody. Activated Probody accumulated in blood might exhibit adverse reactions by binding to an antigen expressed in a normal tissue.

FIG. 3 is a diagram showing a cause of adverse reactions that might be exhibited by Probody. The Probody is in equilibrium between a state where the masking peptide linked via the linker is bound with the antigen binding site and a state where the masking peptide is dissociated. A molecule in the dissociated state can bind to the antigen.

FIG. 4 is a diagram showing a cause of adverse reactions that might be exhibited by Probody. An anti-drug antibody against the masking peptide (anti-masking peptide antibody)

might bind to the masking peptide of Probody before activation and thereby activate the Probody without protease cleavage.

FIG. 5 is a diagram showing the concept of a polypeptide comprising an antigen binding domain and a carrying moiety. (A) The polypeptide with the antigen binding domain linked to the carrying moiety has a long half-life and does not bind to the antigen. (B) The antigen binding domain is released by, for example, cleavage at a cleavage site to bind to the antigen, and the antigen binding domain thus released has a short half-life.

FIG. 6 is a diagram showing one embodiment of a method for producing the polypeptide of the present invention. In the present embodiment, the polypeptide of interest is an IgG antibody-like molecule. (A) An antigen binding domain binding to the target antigen is obtained. (B) The antigen binding domain is associated as a substitute for VH of an IgG antibody with VL such that the antigen binding activity of the antigen binding domain is inhibited. (C) A protease cleavage sequence is introduced into an IgG antibody-like molecule precursor harboring the antigen binding domain.

FIG. 7 is a diagram showing one embodiment of the polypeptide of the present invention. In the present embodiment, the polypeptide is an IgG antibody-like molecule, and antigen binding domains are respectively established at moieties corresponding to two variable regions of the IgG antibody. The two antigen binding domains may have the same antigen binding specificity or may differ in antigen binding specificity.

FIG. 8 is a diagram showing an embodiment in which a second antigen binding domain is further linked to the antigen binding domain of the present invention. In this embodiment, the antigen binding domain and the second antigen binding domain form a bispecific antigen binding molecule after release. FIG. 8(A) is a diagram showing the polypeptide in an unreleased state. The antigen binding activity of the antigen binding domain is inhibited. FIG. 8(B) is a diagram showing the release of the bispecific antigen binding molecule formed by the antigen binding domain and the second antigen binding domain. FIG. 8(C) is a diagram showing a bispecific antigen binding molecule against, for example, a T cell surface antigen and a cancer cell surface antigen, as an example of the bispecific antigen binding molecule after the release.

FIG. 9A is a diagram showing one example of a method for screening for a fusion polypeptide comprising an antigen binding domain whose antigen binding activity can be inhibited or could be lost by associating with a particular inhibiting domain, from a library comprising a plurality of fusion polypeptides of antigen binding domains each linked to a first association sustaining domain. FIG. 9A(1) is a diagram showing the library comprising a plurality of fusion polypeptides of antigen binding domains each linked to a first association sustaining domain. FIG. 9A(2) is a diagram showing that the antigen binding activity of each antigen binding domain is confirmed in a state where the fusion polypeptide associates with an association partner. A fusion polypeptide comprising an antigen binding domain that does not bind to the target antigen or has antigen binding activity of a predetermined value or lower in this state of association is selected. FIG. 9A(3) is a diagram showing that the association of the antigen binding domain in the fusion polypeptide selected in (2) with the inhibiting domain in the association partner is canceled, and the antigen binding activity of the antigen binding domain is confirmed. A fusion polypeptide comprising an antigen binding domain that binds to the target antigen or has antigen binding activity of a predetermined value or higher in this state of non-association is selected. FIG. 9A(2') is a diagram showing that the antigen binding activity of the antigen binding domain in each fusion polypeptide is confirmed. A fusion polypeptide comprising an antigen binding domain that binds to the target antigen or has antigen binding activity of a predetermined value or higher in this state of the fusion polypeptide existing alone is selected. FIG. 9A(3') is a diagram showing that the antigen binding activity of the antigen binding domain is confirmed in a state where the fusion polypeptide selected in (2') associates with an association partner. A fusion polypeptide comprising an antigen binding domain that does not bind to the target antigen or has antigen binding activity of a predetermined value or lower in this state of association is selected.

FIG. 9B is a diagram showing one more specific example of the method for screening for a fusion polypeptide comprising an antigen binding domain whose antigen binding activity can be inhibited or could be lost by associating with a particular inhibiting domain, from a library comprising a plurality of fusion polypeptides of antigen binding domains each linked to a first association sustaining domain. (1) The fusion polypeptides each comprising an antigen binding domain and a first association sustaining domain and an association partner harboring a protease cleavage sequence between an inhibiting domain and a second association sustaining domain are displayed together to form a Fab-like structure; (2) from among the Fab-like structures thus displayed, a structure that does not bind to the antigen or has antigen binding activity of a predetermined value or lower is selected; and (3) the association partner is cleaved by protease, and a fragment comprising an antigen binding domain that binds to the antigen or has antigen binding activity of a predetermined value or higher is selected.

FIG. 9C is a diagram showing another more specific example of the method for screening for a fusion polypeptide comprising an antigen binding domain whose antigen binding activity can be inhibited or could be lost by associating with a particular inhibiting domain, from a library comprising a plurality of fusion polypeptides of antigen binding domains each linked to a first association sustaining domain. (1) The fusion polypeptides each harboring a protease cleavage sequence between an antigen binding domain and a first association sustaining domain and an association partner of an inhibiting domain linked to a second association sustaining domain are displayed together to form a Fab-like structure; (2) from among the Fab-like structures thus displayed, a structure that does not bind to the antigen or has antigen binding activity of a predetermined value or lower is selected; and (3) the fusion polypeptide is cleaved by protease, and a fragment comprising an antigen binding domain that binds to the antigen or has antigen binding activity of a predetermined value or higher is selected.

FIG. 9D is a diagram showing an alternative example of the method for screening for a fusion polypeptide comprising an antigen binding domain whose antigen binding activity can be inhibited or could be lost by associating with a particular inhibiting domain, from a library comprising a plurality of fusion polypeptides of antigen binding domains each linked to a first association sustaining domain. (1) The fusion polypeptides each comprising an antigen binding domain and a first association sustaining domain and an association partner of an inhibiting domain linked to a second association sustaining domain are displayed together to form a Fab-like structure, and from among the Fab-like structures thus displayed, a structure that does not bind to the antigen or has antigen binding activity of a predetermined value or lower is selected; and (2) moieties comprising the antigen binding domains in the Fab-like structures thus selected in (1) are displayed again so as not to express the inhibiting domain together therewith, and a fragment that binds to the antigen or has antigen binding activity of a predetermined value or higher is selected. Each of FIGS. 9D(2') and 9D(2") is a diagram showing an alternative embodiment in which the moieties comprising the antigen binding domains in (2) are displayed again so as not to express the inhibiting domain together therewith. The order of (1) and (2), (2') or (2") may be (2), (2') or (2") preceding (1). Specifically, the moieties comprising the antigen binding domains are displayed so as not to express the inhibiting domain together therewith, and a fragment having antigen binding activity of a predetermined value or higher is selected. Next, fusion polypeptides each comprising an antigen binding domain comprising the fragment having predetermined or larger binding and a first association sustaining domain, and an association partner of an inhibiting domain linked to a second association sustaining domain are displayed together to form a Fab-like structure, and from among the Fab-like structures thus displayed, a structure that does not bind to the antigen or has antigen binding activity of a predetermined value or lower is selected.

FIG. 10 is a diagram showing results of evaluating the human IL6R binding of antibody-like molecules prepared by associating various light chains with IL6R90-G1m containing anti-human IL6R VHH (IL6R90) fused with a human IgG1 constant region (CH1-hinge-CH2-CH3). The time of onset of the action of the antibody-like molecules on antigen-immobilized sensors is a starting point on the abscissa.

FIG. 11(A) is a diagram showing an antibody-like molecule model prepared by inserting a protease cleavage sequence near the boundary between VHH and the constant region in IL6R90-G1m. FIG. 11(B) is a diagram showing the name of each prepared antibody heavy chain, the insertion site of the amino acid sequence, and the inserted amino acid sequence. The insertion site is indicated by [insert].

FIG. 12-1 is a diagram showing results of evaluating the degree of cleavage by reducing SDS-PAGE after protease (MT-SP1) treatment of IL6R90-G1m or antibody-like molecules prepared by inserting a protease cleavage sequence near the boundary between VHH and the constant region in IL6R90-G1m. Of two new bands resulting from the protease treatment, the band appearing at 25 kDa or smaller is a band derived from the VHH, and the band appearing at a position of 25 to 50 kDa is a band derived from the constant region.

FIG. 12-2 is a diagram continued from FIG. 12-1.

FIG. 13 is a diagram showing results of evaluating the human IL6R binding of IL6R90-G1m or antibody-like molecules prepared by inserting a protease cleavage sequence near the boundary between VHH and the constant region in IL6R90-G1m, or these samples after protease (MT-SP1) treatment. Protease– depicts sensorgrams of evaluating the binding of the protease-untreated antibody-like molecules to the antigen, and Protease+depicts sensorgrams of evaluating the binding of the protease-treated antibody-like molecules to the antigen. 30 seconds before onset of the action of the antibody-like molecules on antigen-immobilized sensors are a starting point on the abscissa.

FIG. 14 is a diagram showing results of evaluating the human IL6R binding of antibody-like molecules prepared by associating various light chains with 20A11-G1m containing anti-human IL6R VHH (20A11) fused with a human IgG1 constant region (CH1-hinge-CH2-CH3). 30 seconds before the time of onset of the action of the antibody-like molecules on antigen-immobilized sensors are a starting point on the abscissa.

FIG. 15 is a diagram showing results of evaluating the human IL6R binding of 20A11-G1m or antibody-like molecules prepared by introducing mutations to amino acids present at the interface between 20A11 and VL and associating various light chains with 20A11hu-G1m containing the thus-prepared 20A11hu fused with a human IgG1 constant region (CH1-hinge-CH2-CH3). 60 seconds before the time of onset of the action of the antibody-like molecules on antigen-immobilized sensors are a starting point on the abscissa.

FIG. 16 is a diagram showing results of evaluating the degree of cleavage by reducing SDS-PAGE after protease (MT-SP1) treatment of 20A11-G1m or 4 types of antibody-like molecules prepared by inserting a protease cleavage sequence near the boundary between 20A11hu and the constant region in 20A11hu-G1m. Of two new bands resulting from the protease treatment, the band appearing at 25 kDa or smaller is a band derived from the VHH, and the band appearing at a position of 25 to 50 kDa is a band derived from the constant region.

FIG. 17 is a diagram showing results of evaluating the human IL6R binding of 20A11-G1m or antibody-like molecules prepared by inserting a protease cleavage sequence near the boundary between VHH and the constant region in 20A11hu-G1m, or these samples after protease (MT-SP1) treatment. Protease– depicts sensorgrams of evaluating the binding of the protease-untreated antibody-like molecules to the antigen, and Protease+depicts sensorgrams of evaluating the binding of the protease-treated antibody-like molecules to the antigen. 60 seconds before onset of the action of the antibodies on antigen-immobilized sensors are a starting point on the abscissa. The sample with the term "not tested" represents that the sample was not assayed.

FIG. 18 is a diagram showing results of evaluating the degree of cleavage by migration in reducing SDS-PAGE and detection with CBB after protease (MT-SP1) treatment of antibody-like molecules that had anti-human CD3 VHH in their heavy chain variable regions and were prepared by inserting a protease cleavage sequence near the boundary between the VHH and the heavy chain constant region. Of two new bands resulting from the protease treatment, the band appearing around 10 to 15 kDa is a band derived from the VHH, and the band appearing around 37 kDa is a band derived from the heavy chain constant region.

FIG. 19 is a diagram showing results of evaluating the human CD3ed-Fc binding of samples after protease (MT-SP1) treatment of antibody-like molecules that had anti-human CD3 VHH in their heavy chain variable regions and were prepared by inserting a protease cleavage sequence near the boundary between the VHH and the heavy chain constant region. Protease– depicts sensorgrams of evaluating the binding of the protease-untreated antibody-like molecules to the antigen, and Protease+depicts sensorgrams of evaluating the binding of the protease-treated antibody-like molecules to the antigen. 30 seconds before onset of the action of the antibody-like molecules on antigen-immobilized sensors are a starting point on the abscissa. The binding is shown when a response before antigen binding was defined as 0 and a response before action of the antibodies was defined as 100. The time starting at 30 seconds before action of the antibodies is shown.

FIG. 20 is a diagram showing results of evaluating the degree of cleavage by migration in reducing SDS-PAGE and detection with CBB after protease (MT-SP1) treatment of a molecule having IL6R90-G1m as a heavy chain and Vk1-39-k0MT as a light chain, or antibody-like molecules prepared by inserting a protease cleavage sequence near the boundary between the light chain variable region and the light chain constant region of the molecule having IL6R90-G1m as a heavy chain and Vk1-39-k0MT as a light chain. Two bands derived from the light chain resulted from the protease treatment, and the light chain was cleaved by protease.

FIG. 21 is a diagram showing results of evaluating the human IL6R binding of samples after protease (MT-SP1) treatment of a molecule having IL6R90-G1m as a heavy chain and Vk1-39-k0MT as a light chain, or antibody-like molecules prepared by inserting a protease cleavage sequence near the boundary between the light chain variable region and the light chain constant region of the molecule having IL6R90-G1m as a heavy chain and Vk1-39-k0MT as a light chain. Protease– depicts sensorgrams of evaluating the binding of the protease-untreated antibody-like molecules to the antigen, and Protease+depicts sensorgrams of evaluating the binding of the protease-treated antibody-like molecules to the antigen. An antibody (MRA) confirmed to bind to IL6R was used as a positive control. The time of onset of the action of the antibody-like molecules on antigen-immobilized sensors is a starting point on the abscissa.

FIG. 22 is a diagram showing SDS-PAGE results of evaluating the protease cleavage of IgG antibody-like molecules with incorporated VHH binding to human plexin A1. Protease(+) lane depicts samples treated by protease cleavage, and protease(–) lane depicts negative control samples without the protease cleavage treatment.

FIG. 23 is a diagram showing Octet sensorgrams of evaluating the human plexin A1 binding of VHH released by protease cleavage from IgG antibody-like molecules with incorporated VHH binding to human plexin A1. Protease+ depicts samples treated by protease cleavage, and protease– depicts samples without the protease cleavage treatment. The concentrations of the IgG antibody-like molecules used are described on the left side of the diagram.

Figure 42:
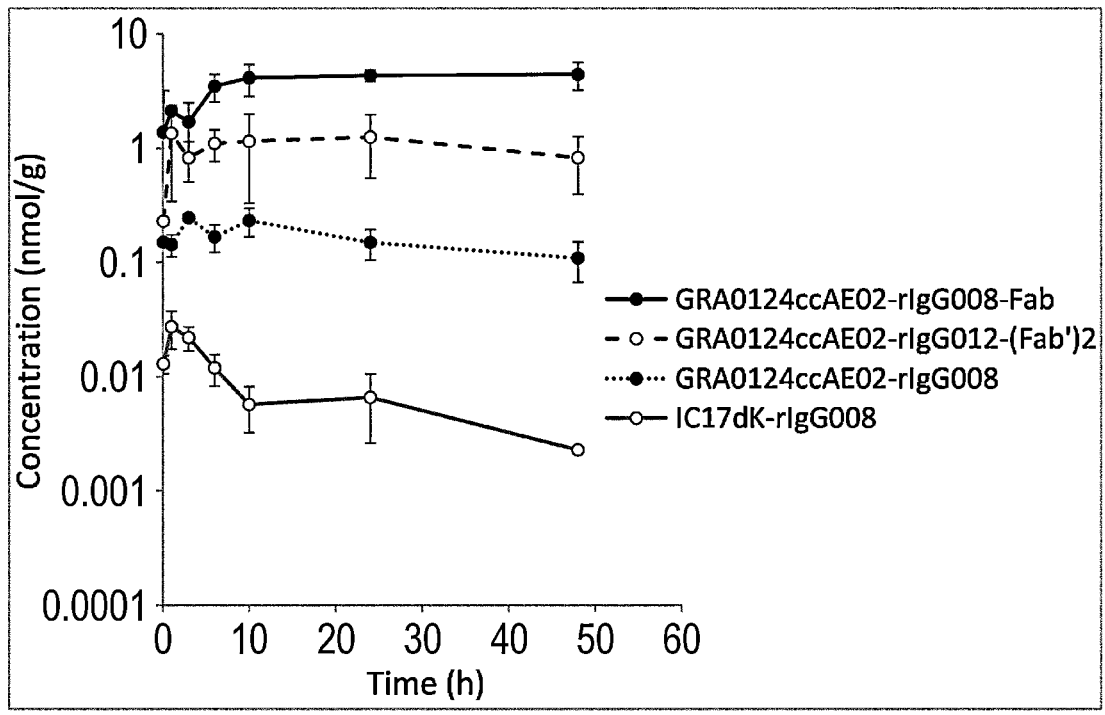

FIG. 42 shows concentration-time profiles of GRA0124ccAE02-rIgG008-Fab, GRA0124ccAE02-rIgG012-F(ab')2, GRA0124ccAE02-rIgG008 and IC17dK-rIgG008 in rabbit articular cartilage after intraarticular administration.

Figure 43:
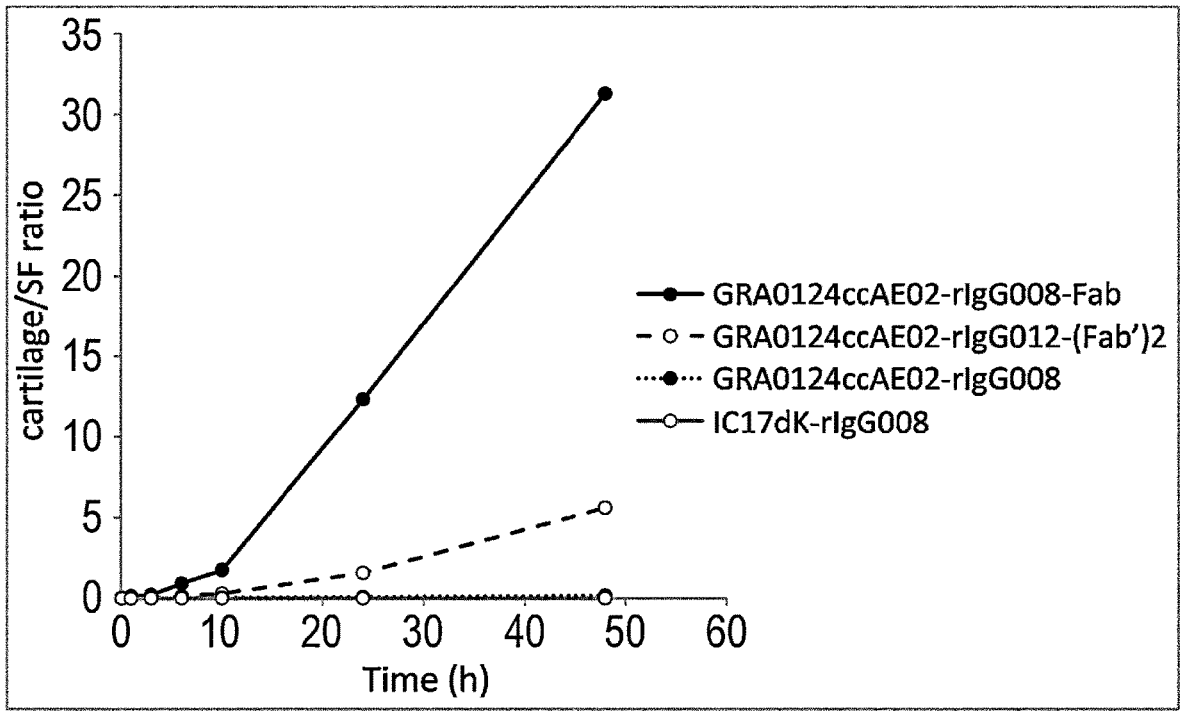

FIG. 43 shows cartilage/synovial fluid concentrations ratio of GRA0124ccAE02-rIgG008-Fab, GRA0124ccAE02-rIgG012-F(ab')2, GRA0124ccAE02-rIgG008 and IC17dK-rIgG008 in rabbit articular cartilage after intraarticular administration.

Figure 44:
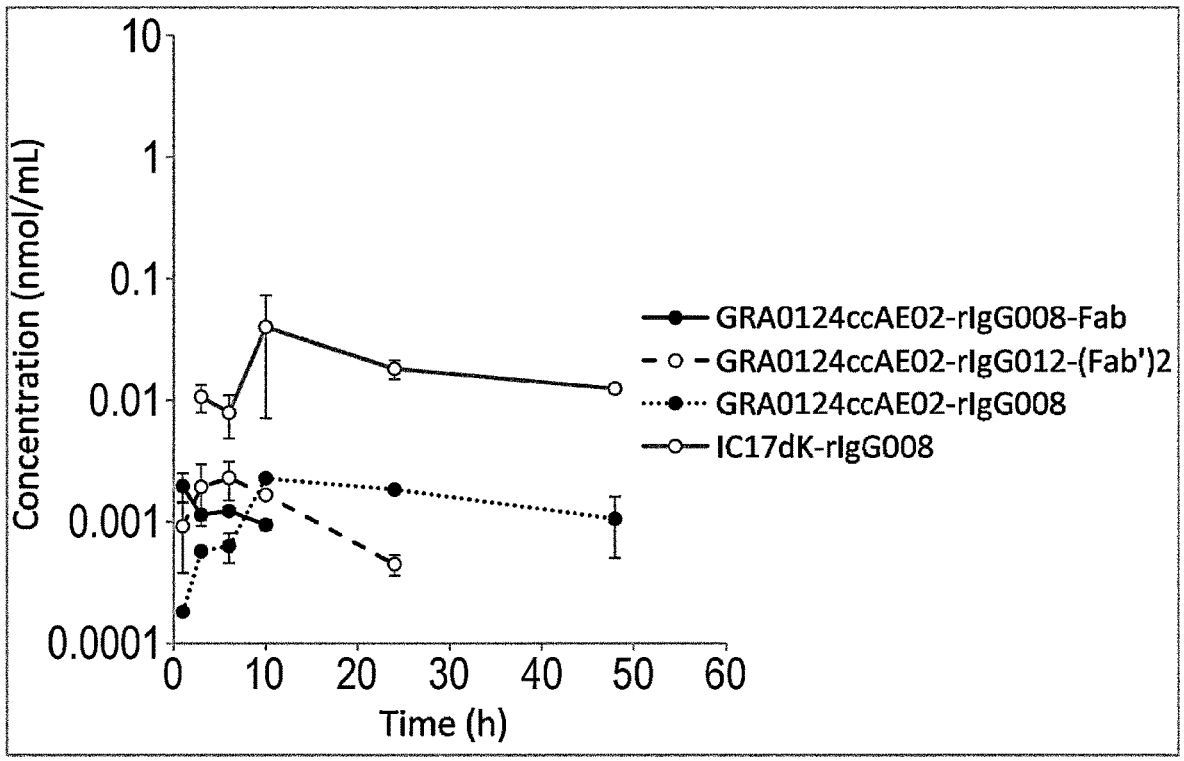

FIG. 44 shows concentration-time profiles of GRA0124ccAE02-rIgG008-Fab, GRA0124ccAE02-rIgG012-F(ab')2, GRA0124ccAE02-rIgG008 and IC17dK-rIgG008 in rabbit plasma after intraarticular administration.

FIG. 45 shows the protease cleavage of hA2R3p.038-G1mISHI01/VK1.39-k0MT and hA2R3p.038v1-G1mISHI01/VK1.39-k0MT.

Figure 46:
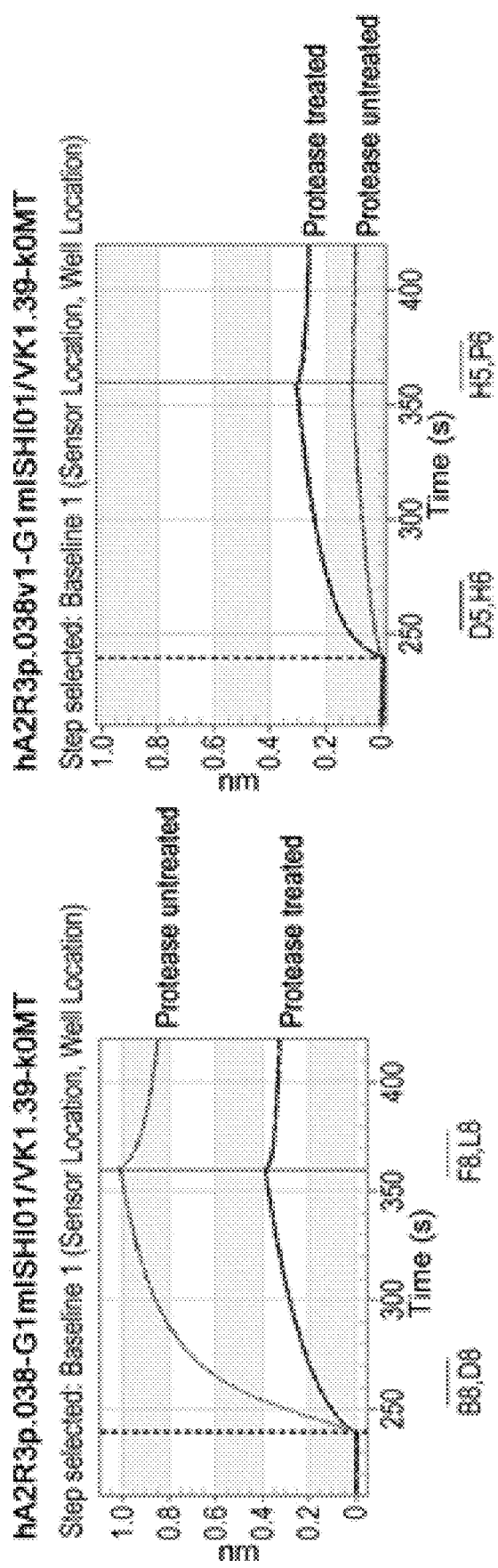

FIG. 46 shows the change of binding property of hA2R3p.038-G1mISHI01/VK1.39-k0MT and hA2R3p.038v1-G1mISHI01/VK1.39-k0MT to human aggrecan G1-IGD-G2 domain by protease treatment.

Figure 47:
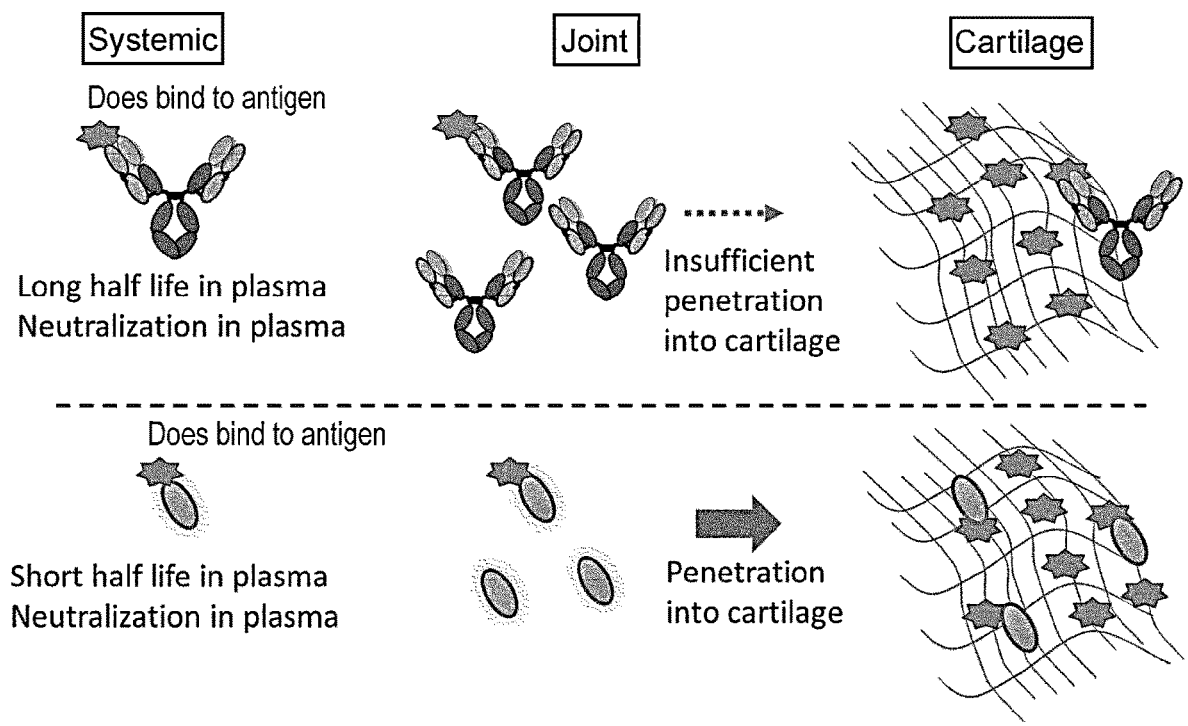

FIG. 47 depicts difficulties of protein therapeutics targeting cartilage.

Figure 48:
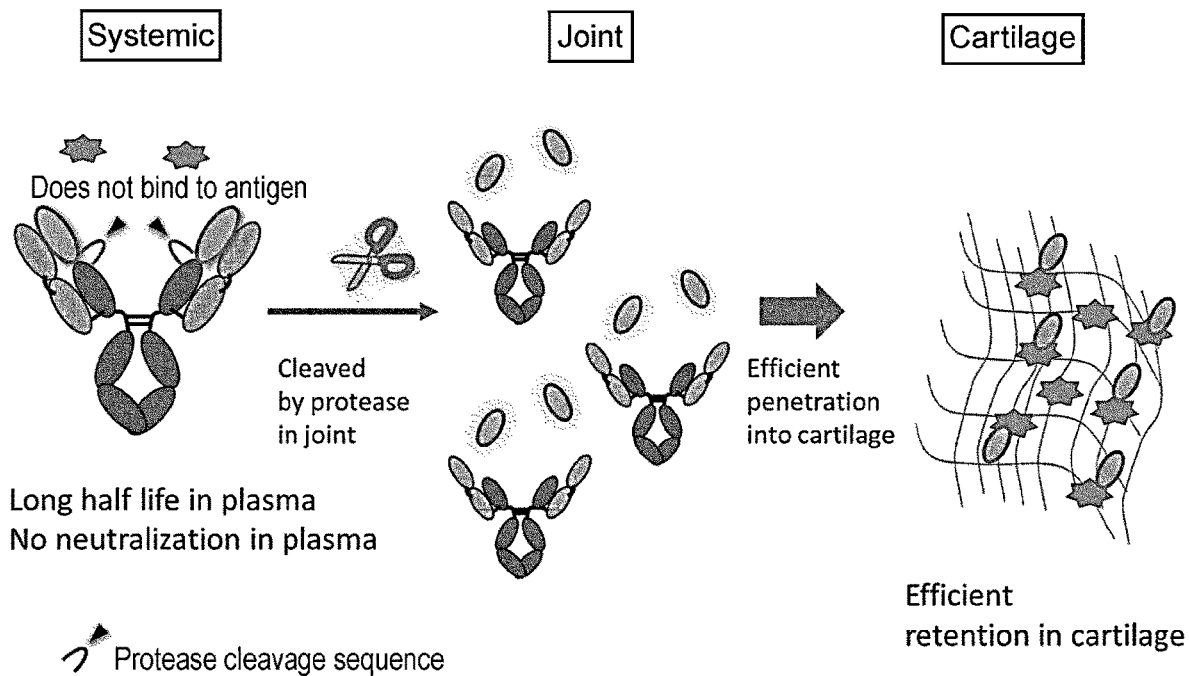

FIG. 48 depicts advantage of the polypeptide of the present invention for protein therapeutics targeting cartilage.

Figure 49:
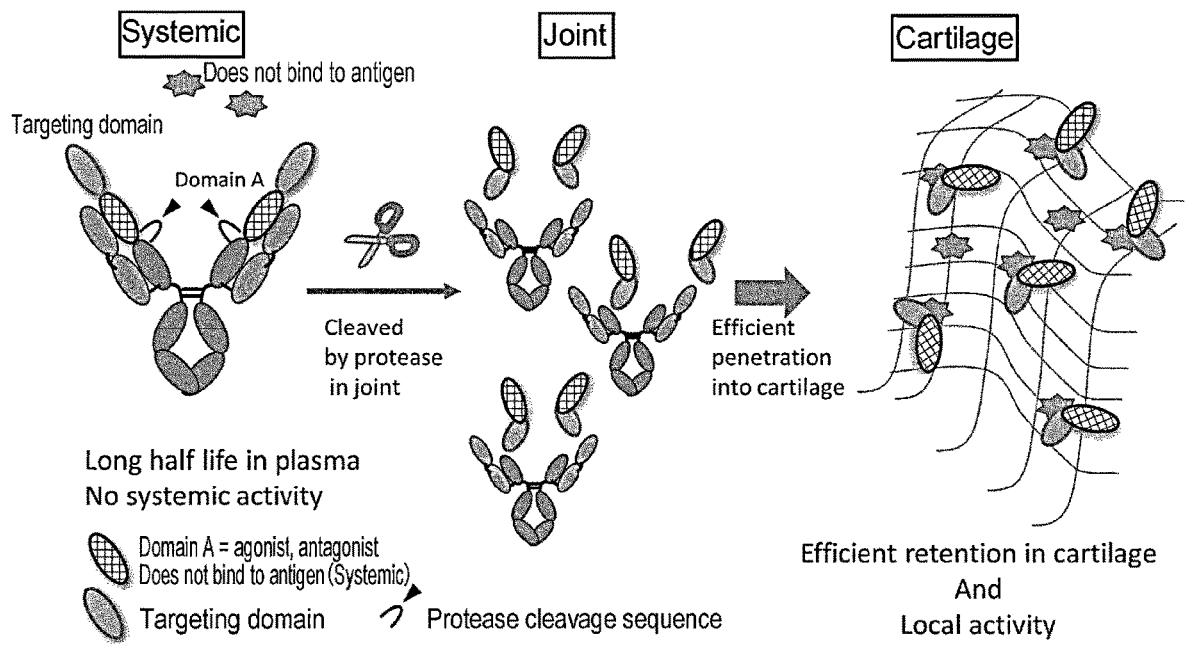

FIG. 49 depicts the action of the polypeptide of the present invention having two domains such as targeting molecule and agonist or antagonist molecule.

FIG. 50 is a graph for Fab concentration of anti-aggrecan antibodies in the cartilage. The white bar represents initial Fab concentration and the black bar represents Fab concentration of 6 days after incubation.

Figure 51:
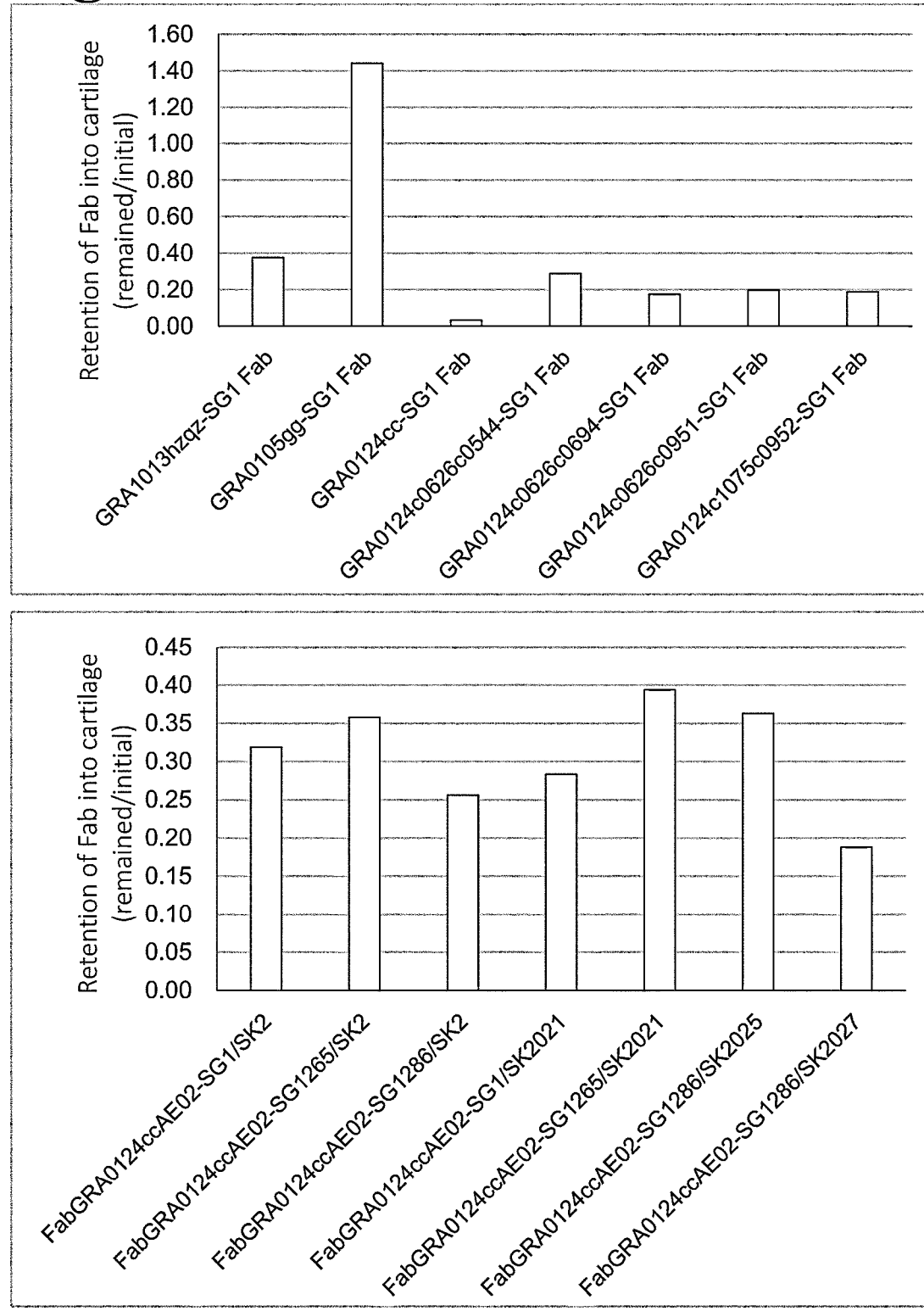

FIG. 51 is a graph showing the Fab retention of anti-aggregcan antibodies.

Figure 52:
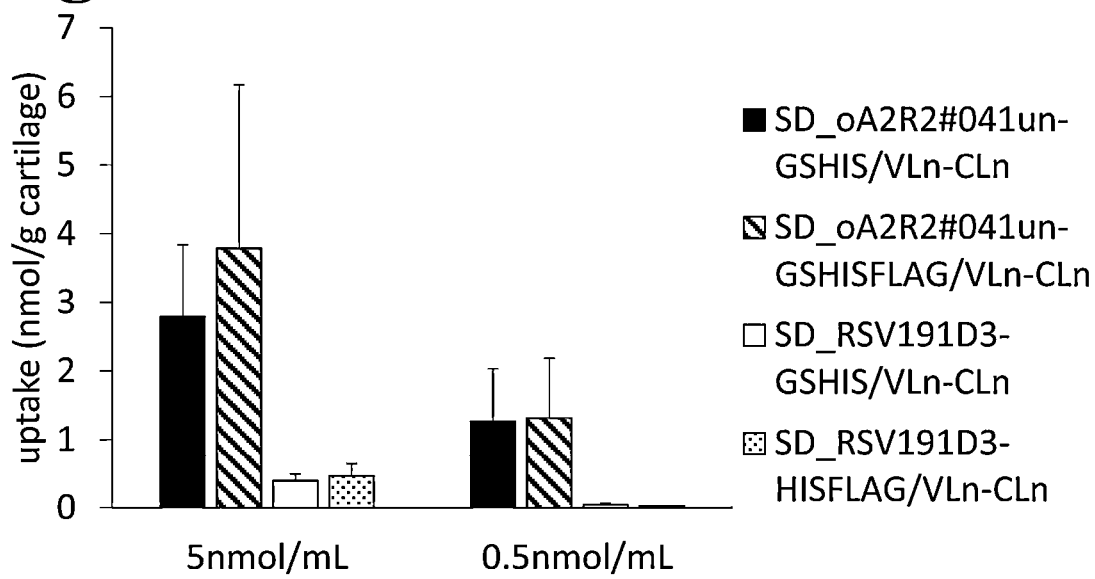

FIG. 52 shows uptake amount of anti-aggrecan VHHs and negative-control VHHs in rabbit cartilage explant culture.

DESCRIPTION OF EMBODIMENTS

The present invention relates to a polypeptide comprising an antigen binding domain which binds to a molecule present in a cartilage tissue. The antibody of the present invention is capable of penetrating into a deeper zone of cartilage tissue, and retaining in the cartilage tissue for a long period (Example 25). It suggests that anti-cartilage antibodies are useful for delivering a desired drug and/or functional antibodies themselves to cartilage tissue and retaining them in the cartilage for a long period.

The present invention also relates to a polypeptide comprising (i) an antigen biding domain which binds to a molecule in a cartilage tissue, and (ii) a carrying moiety. In the polypeptide of the present invention, the carrying moiety has an inhibiting domain that inhibits an antigen binding activity of the antigen biding domain. In one embodiment, the antigen biding domain has a shorter half-life in blood than the half-life of the carrying moiety.

The polypeptide comprising the above antigen binding domain is useful in treating and/or preventing a disease or disorder in which the above protein(s) is involved in. Specifically, the polypeptide of the present invention is useful in treating and/or preventing an Aggrecan mediated disease or disorder. Examples of such a disease or disorder include, but are not limited to, osteoarthritis (OA), cartilage degradation in osteoarthritis (OA), traumatic arthritis, degenerative disc disease, temporomandibular joint arthrosis, and osteitis pubis. In one embodiment, an Aggrecan mediated disease or disorder is an Aggrecan associated disease or disorder.

A polypeptide of the present invention can be cleaved at a designed site by a protease that is expressed in a disease tissue-specific manner. An antigen binding domain is released from the polypeptide by this cleavage. Such released antigen binding domain can penetrate to a deep part of a disease tissue due to the small molecular weight of the domain. Thus, the polypeptide of the present invention can target an antigen present in a deep part of a disease tissue such as a cartilage tissue.

In particular, chondrocytes are fully surrounded by cartilage matrix which is abundant for collagen type II and aggrecan. In order to deliver sufficient amount of drug molecules to cartilage tissue and chondrocytes, the property of drug molecules needs to be carefully designed. It is known that molecular size affects its penetration ability into articular cartilage. As shown in Example 24 of the specification, it is considered that the antigen binding domain comprised in the polypeptide of the present invention can sufficiently penetrate into cartilage tissue and chondrocytes. Accordingly, the polypeptide of the present invention is useful in treating and/or preventing a disease or disorder in a bone tissue including osteoarthritis.

The polypeptide according to the present invention usually refers to a peptide having a length on the order of 4 amino acids or longer, and a protein. Also, the polypeptide according to the present invention is usually a polypeptide consisting of an artificially designed sequence, but is not limited thereto. For example, an organism-derived polypeptide may be used. Alternatively, the polypeptide according to the present invention may be any of a natural polypeptide, a synthetic polypeptide, a recombinant polypeptide, and the like. Furthermore, fragments of these polypeptides are also included in the polypeptide of the present invention.

In the present specification, each amino acid is indicated by one-letter code or three-letter code, or both, as represented by, for example, Ala/A, Leu/L, Arg/R, Lys/K, Asn/N, Met/M, Asp/D, Phe/F, Cys/C, Pro/P, Gln/Q, Ser/S, Glu/E, Thr/T, Gly/G, Trp/W, His/H, Tyr/Y, Ile/I, or Val/V. For expressing an amino acid located at a particular position, an expression using a number representing the particular position in combination with the one-letter code or the three-letter code of the amino acid can be appropriately used. For example, an amino acid 37V, which is an amino acid contained in a single-domain antibody, represents Val located at position 37 defined by the Kabat numbering.

For the alteration of an amino acid in the amino acid sequence of a polypeptide, a method known in the art such as site-directed mutagenesis (Kunkel et al. (Proc. Natl. Acad. Sci. USA (1985) 82, 488-492)) or overlap extension PCR can be appropriately adopted. A plurality of methods known in the art can also be adopted as alteration methods for substituting an amino acid by an amino acid other than a natural amino acid (Annu. Rev. Biophys. Biomol. Struct. (2006) 35, 225-249; and Proc. Natl. Acad. Sci. U.S.A. (2003) 100 (11), 6353-6357). For example, a tRNA-containing cell-free translation system (Clover Direct (Protein Express)) having a non-natural amino acid bound with amber suppressor tRNA complementary to UAG codon (amber codon), which is a stop codon, is also preferably used. In the present specification, examples of the alteration include, but are not limited to, substitution.

In the present specification, the term "and/or" used to represent amino acid alteration sites is meant to include every combination appropriately represented by "and" and "or". Specifically, for example, the phrase "amino acids at positions 37, 45, and/or 47 are substituted" includes the following variations of amino acid alteration: (a) position 37, (b) position 45, (c) position 47, (d) positions 37 and 45, (e) positions 37 and 47, (f) positions 45 and 47, and (g) positions 37, 45 and 47.

In the present specification, expression in which the one-letter codes or three-letter-codes of amino acids before and after alteration are used previous and next to a number representing a particular position can be appropriately used for representing amino acid alteration. For example, an alteration F37V or Phe37Val used for substituting an amino acid contained in an antibody variable region or a single-domain antibody represents the substitution of Phe at position 37 defined by the Kabat numbering by Val. Specifically, the number represents an amino acid position defined by the Kabat numbering; the one-letter code or three-letter code of the amino acid previous to the number represents the amino acid before the substitution; and the one-letter code or three-letter code of the amino acid next to the number represents the amino acid after the substitution. Likewise, an alteration P238A or Pro238Ala used for substituting an amino acid in a Fc region contained in an antibody constant region represents the substitution of Pro at position 238 defined by the EU numbering by Ala. Specifically, the number represents an amino acid position defined by the EU numbering; the one-letter code or three-letter code of the amino acid previous to the number represents the amino acid before the substitution; and the one-letter code or three-letter code of the amino acid next to the number represents the amino acid after the substitution.

In the present specification, the term "antibody" is used in the broadest sense and encompasses various antibody structures including, but are not limited to, a monoclonal antibody, a polyclonal antibody, a multispecific antibody (e.g., a bispecific antibody), a single-domain antibody, and an antibody fragment as long as the antibody exhibits the desired antigen binding activity.

The "antibody fragment" refers to a molecule, other than a complete antibody, containing a portion of the complete antibody and binding to an antigen to which the complete antibody binds. Examples of the antibody fragment include, but are not limited to, Fv, Fab, Fab', Fab'-SH, F(ab')2, diabody, linear antibodies, single-chain antibody molecules (e.g., scFv), and multispecific antibodies formed from antibody fragments.

The terms "full-length antibody", "complete antibody", and "whole antibody" are used interchangeably with each other in the present specification and refer to an antibody having a structure substantially similar to a natural antibody structure, or having heavy chains containing a Fc region defined in the present specification.

The term "variable region" or "variable domain" refers to a region or a domain of an antibody heavy chain or light chain involved in the binding of the antibody to its antigen. Usually, antibody heavy chain and light chain variable domains (VH and VL, respectively) are structurally similar and each contain 4 conserved framework regions (FRs) and 3 complementarity determining regions (CDRs) (see e.g., Kindt et al., Kuby Immunology, 6th ed., W. H. Freeman and Co., page 91 (2007)). One VH or VL domain may suffice for conferring antigen binding specificity.

The term "complementarity determining region" or "CDR" used in the present specification is hypervariable in the sequence, and/or forms a structurally determined loop ("hypervariable loop"), and/or refers to antigen contact residues ("antigen contacts") or each region of an antibody variable domain. Usually, an antibody contains 6 CDRs: three in VH (H1, H2, and H3), and three in VL (L1, L2, and L3). In the present specification, exemplary CDRs include the following:

(a) hypervariable loops formed at amino acid residues 26 to 32 (L1), 50 to 52 (L2), 91 to 96 (L3), 26 to 32 (H1), 53 to 55 (H2), and 96 to 101 (H3) (Chothia and Lesk, J. Mol. Biol. 196: 901-917 (1987));

(b) CDRs formed at amino acid residues 24 to 34 (L1), 50 to 56 (L2), 89 to 97 (L3), 31 to 35b (H1), 50 to 65 (H2), and 95 to 102 (H3) (Kabat et al., Sequences of Proteins of Immunological Interest, 5th Ed. Public Health Service, National Institutes of Health, Bethesda, MD (1991));

(c) antigen contacts formed at amino acid residues 27c to 36 (L1), 46 to 55 (L2), 89 to 96 (L3), 30 to 35b (H1), 47 to 58 (H2), and 93 to 101 (H3) (MacCallum et al., J. Mol. Biol. 262: 732-745 (1996)); and (d) a combination of (a), (b), and/or (c) containing HVR amino acid residues 46 to 56 (L2), 47 to 56 (L2), 48 to 56 (L2), 49 to 56 (L2), 26 to 35 (H1), 26 to 35b (H1), 49 to 65 (H2), 93 to 102 (H3), and 94 to 102 (H3).

In the present specification, CDR residues and other residues (e.g., FR residues) in a variable domain are numbered according to Kabat et al. (supra), unless otherwise specified.

The term "framework" or "FR" refers to variable domain residues other than complementarity determining region (CDR) residues. FRs in a variable domain consist of 4 FR domains: FR1, FR2, FR3, and FR4. Accordingly, the sequences of CDRs and FRs usually appear in VH (or VL) in the following order: FR1-H1 (L1)-FR2-H2 (L2)-FR3-H3 (L3)-FR4.

In the present specification, the term "constant region" or "constant domain" refers to a region or a domain other than variable regions in an antibody. For example, an IgG antibody is a heterotetrameric glycoprotein of approximately 150,000 Da constituted by two identical light chains and two identical heavy chains connected through disulfide bonds. Each heavy chain has a variable region (VH) also called variable heavy chain domain or heavy chain variable domain, followed by a heavy chain constant region (CH) containing a CH1 domain, a hinge region, a CH2 domain, and a CH3 domain, from the N terminus toward the C terminus. Likewise, each light chain has a variable region (VL) also called variable light chain domain or light chain variable domain, followed by a constant light chain (CL) domain, from the N terminus toward the C terminus. The light chains of natural antibodies may be attributed to one of two types called kappa and lambda on the basis of the amino acid sequences of their constant domains.

In the present specification, the term "Fc region" is used for defining the C-terminal region of immunoglobulin heavy chains, including at least a portion of constant regions. This term includes a Fc region having a natural sequence and a mutant Fc region. In one embodiment, the heavy chain Fc region of human IgG1 spans from Cys226 or Pro230 to the carboxyl terminus of the heavy chain. However, the C-terminal lysine (Lys447) or glycine-lysine (Gly446-Lys447) of the Fc region may be present or absent. In the present specification, amino acid residues in a Fc region or a constant region are numbered according to the EU numbering system (also called EU index) described in Kabat et al., Sequences of Proteins of Immunological Interest, 5th Ed. Public Health Service, National Institutes of Health, Bethesda, M D 1991, unless otherwise specified.

The "class" of an antibody refers to the type of a constant domain or a constant region carried by the heavy chain of the antibody. Antibodies have 5 major classes: IgA, IgD, IgE, IgG, and IgM. Some of these classes may be further divided into subclasses (isotypes), for example, IgG1, IgG2, IgG3, IgG4, IgA1, and IgA2. Heavy chain constant domains corresponding to immunoglobulins of different classes are called alpha, delta, epsilon, gamma, and mu, respectively.

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "human consensus framework" is a framework which represents the most commonly occurring amino acid residues in a selection of human immunoglobulin VL or VH framework sequences. Generally, the selection of human immunoglobulin VL or VH sequences is from a subgroup of variable domain sequences. Generally, the subgroup of sequences is a subgroup as in Kabat et al., Sequences of Proteins of Immunological Interest, Fifth Edition, NIH Publication 91-3242, Bethesda MD (1991), vols. 1-3. In one embodiment, for the VL, the subgroup is subgroup kappa I as in Kabat et al., supra. In one embodiment, for the VH, the subgroup is subgroup III as in Kabat et al., supra.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3). Exemplary HVRs herein include:
 (a) hypervariable loops occurring at amino acid residues 26-32 (L1), 50-52 (L2), 91-96 (L3), 26-32 (H1), 53-55 (H2), and 96-101 (H3) (Chothia and Lesk, J. Mol. Biol. 196:901-917 (1987));
 (b) CDRs occurring at amino acid residues 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service, National Institutes of Health, Bethesda, MD (1991));
 (c) antigen contacts occurring at amino acid residues 27c-36 (L1), 46-55 (L2), 89-96 (L3), 30-35b (H1), 47-58 (H2), and 93-101 (H3) (MacCallum et al. J. Mol. Biol. 262: 732-745 (1996)); and
 (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

The term "monoclonal antibody" as used herein refers to an antibody obtained from a population of substantially homogeneous antibodies, i.e., the individual antibodies composing the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci.

A "naked antibody" refers to an antibody that is not conjugated to a heterologous moiety (e.g., a cytotoxic moiety) or radiolabel. The naked antibody may be present in a pharmaceutical formulation.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide-bonded. From N- to C-terminus, each heavy chain has a variable region (VH), also called a variable heavy domain or a heavy chain variable domain, followed by three constant domains (CH1, CH2, and CH3). Similarly, from N- to C-terminus, each light chain has a variable region (VL), also called a variable light domain or a light chain variable domain, followed by a constant light (CL) domain. The light chain of an antibody may be assigned to one of two types, called kappa and lambda, based on the amino acid sequence of its constant domain.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative. One or more pharmaceutically acceptable carriers can be included in the compositions of the present invention.

The term "functionally equivalent" referes to retaining equivalent function. In one embodiment, functionally equivalent antibody variable regions substantially share at least one major functional property, for example, binding specificity to the antigen. In one embodiment, two functionally equivalent antibody variable regions compete with each other for the antigen. In one preferable embodiment, equivalent antibody variable regions bind to substantially the same epitope of the antigen. In a further or alternative embodiment, functionally equivalent antibody variable region contains CDRs having at least 75% or higher, preferably 80% or higher, 85% or higher, 90% or higher, or 95% higher, or 98% higher, or 99% or higher sequence identity (in total amino acid sequence of all CDRs contained in the variable region) with CDRs of the reference variable region. In a further or alternative embodiment, functionally equivalent antibody variable regions contains CDRs in which 10 or less, 9 or less, 8 or less, 7 or less, 6 or less, 5 or less, 4 or less, 3 or less, 1 or less, or 1 amino acid is different (in total amino acid sequence of all CDRs contained in the variable region) from CDRs of the reference variable region.

In the present specification, the "antigen binding domain" is limited only by binding to the antigen of interest. The antigen binding domain can be a domain having any structure as long as the domain used binds to the antigen of interest. Examples of such a domain include, but are not limited to, an antibody heavy chain variable region (VH), an antibody light chain variable region (VL), a single-domain antibody (sdAb), an antagonist, a module called A domain of approximately 35 amino acids contained in an in vivo cell membrane protein avimer (International Publication Nos. WO2004/044011 and WO2005/040229), adnectin containing a 10Fn3 domain serving as a protein binding domain derived from a glycoprotein fibronectin expressed on cell membranes (International Publication No. WO2002/032925), Affibody containing an IgG binding domain scaffold constituting a three-helix bundle composed of 58 amino acids of protein A (International Publication No. WO1995/001937), DARPins (designed ankyrin repeat proteins) which are molecular surface-exposed regions of ankyrin repeats (AR) each having a 33-amino acid residue structure folded into a subunit of a turn, two antiparallel helices, and a loop (International Publication No. WO2002/020565), anticalin having four loop regions connecting eight antiparallel strands bent toward the central axis in one end of a barrel structure highly conserved in lipocalin molecules such as neutrophil gelatinase-associated lipocalin (NGAL) (International Publication No. WO2003/029462), and a depressed region in the internal parallel sheet structure of a horseshoe-shaped fold composed of repeated leucine-rich-repeat (LRR) modules of an immunoglobulin structure-free variable lymphocyte receptor (VLR) as seen in the acquired immune systems of jawless vertebrates such as lamprey or hagfish (International Publication No. WO2008/016854).

Preferred examples of the antigen binding domain of the present invention include an antigen binding domain that can exert an antigen binding function by a molecule constituted only by the antigen binding domain, and an antigen binding domain that can exert an antigen binding function by itself after being released from an additional peptide linked thereto. Examples of such an antigen binding domain include, but are not limited to, a single-domain antibody, scFv, Fv, Fab, Fab', F(ab')2, and an antagonist.

One preferred example of the antigen binding domain of the present invention includes an antigen binding domain having a molecular weight of 120k Da, 100k Da, 80k Da, 60 kDa or smaller. Examples of such an antigen binding domain include, but are not limited to, single-domain antibodies, scFv, Fab, F(ab')2, and an antagonist. The antigen binding domain having a molecular weight of 60 kDa or smaller is usually likely to cause clearance by the kidney when existing as a monomer in blood (see J Biol Chem. 1988 Oct. 15; 263 (29): 15064-70). In one embodiment, as shown in Example 24 and 25 of the instant specification, the antigen binding domain having a molecular weight of 120 kDa or smaller is likely to cause penetrate deeply in the cartilage tissue.

From another viewpoint, one preferred example of the antigen binding domain of the present invention includes an antigen binding domain having a half-life in blood of 12 hours or shorter. Examples of such an antigen binding domain include, but are not limited to, single-domain antibodies, scFv, Fab, Fab', and an antagonist.

One preferred example of the antigen binding domain of the present invention includes a single-domain antibody (sdAb), and an antagonist.

In the present specification, the term "single-domain antibody" is not limited by its structure as long as the domain can exert antigen binding activity by itself. It is known that a general antibody, for example, an IgG antibody, exhibits antigen binding activity in a state where a variable region is formed by the pairing of VH and VL, whereas the own domain structure of the single-domain antibody can exert antigen binding activity by itself without pairing with another domain. Usually, the single-domain antibody has a relatively low molecular weight and exists in the form of a monomer.

Examples of the single-domain antibody include, but are not limited to, antigen binding molecules congenitally lacking a light chain, such as VHH of an animal of the family Camelidae and shark $V_{NAR}$, and antibody fragments containing the whole or a portion of an antibody VH domain or the whole or a portion of an antibody VL domain. Examples of the single-domain antibody which is an antibody fragment containing the whole or a portion of an antibody VH or VL domain include, but are not limited to, artificially prepared single-domain antibodies originating from human antibody VH or human antibody VL as described in U.S. Pat. No. 6,248,516 B1, etc. In some embodiments of the present invention, one single-domain antibody has three CDRs (CDR1, CDR2 and CDR3).

The single-domain antibody can be obtained from an animal capable of producing the single-domain antibody or by the immunization of the animal capable of producing the single-domain antibody. Examples of the animal capable of producing the single-domain antibody include, but are not limited to, animals of the family Camelidae, and transgenic animals harboring a gene capable of raising the single-domain antibody. The animals of the family Camelidae include camels, lamas, alpacas, one-hump camels and guanacos, etc. Examples of the transgenic animals harboring a gene capable of raising the single-domain antibody include, but are not limited to, transgenic animals described in International Publication No. WO2015/143414 and U.S. Patent Publication No. US2011/0123527 A1. The framework sequences of the single-domain antibody obtained from the animal may be converted to human germline sequences or sequences similar thereto to obtain a humanized single-domain antibody. The humanized single-domain antibody (e.g., humanized VHH) is also one embodiment of the single-domain antibody of the present invention.

Alternatively, the single-domain antibody can be obtained by ELISA, panning, or the like from a polypeptide library containing single-domain antibodies. Examples of the polypeptide library containing single-domain antibodies include, but are not limited to, naive antibody libraries obtained from various animals or humans (e.g., Methods in Molecular Biology 2012 911 (65-78); and Biochimica et Biophysica Acta-Proteins and Proteomics 2006 1764: 8 (1307-1319)), antibody libraries obtained by the immunization of various animals (e.g., Journal of Applied Microbiology 2014 117: 2 (528-536)), and synthetic antibody libraries prepared from antibody genes of various animals or humans (e.g., Journal of Biomolecular Screening 2016 21: 1 (35-43); Journal of Biological Chemistry 2016 291:24 (12641-12657); and AIDS 2016 30: 11 (1691-1701)).

In one embodiment, the sequences of CDRs and frameworks of a single domain antibody usually appear in the following order: FR1-H1 (L1)-FR2-H2 (L2)-FR3-H3 (L3)-FR4.

Generally, a single domain antibody of the present invention can be defined as a polypeptide comprising:
- a) An amino acid sequence that is comprised of four framework regions/sequences interrupted by three complementarity determining regions/sequences (in which the amino acid residue at position 11 according to the Kabat numbering is chosen from the group consisting of L, M, S, V, and W, and is preferably L); and/or:
- b) An amino acid sequence that is comprised of four framework regions/sequences interrupted by three complementarity determining regions/sequences (in which the amino acid residue at position 37 according to the Kabat numbering is chosen from the group consisting of F, Y, H, I, L, and V, and is preferably F or Y); and/or:
- c) An amino acid sequence that is comprised of four framework regions/sequences interrupted by three complementarity determining regions/sequences (in which the amino acid residue at position 44 according to the Kabat numbering is chosen from the group consisting of G, E, A, D, Q, R, S, and L, and is preferably G, E, or Q); and/or:
- d) An amino acid sequence that is comprised of four framework regions/sequences interrupted by three complementarity determining regions/sequences (in which the amino acid residue at position 45 according to the Kabat numbering is chosen from the group consisting of L, R, C, I, L, P, Q and V, and is preferably L or R); and/or:
- e) An amino acid sequence that is comprised of four framework regions/sequences interrupted by three complementarity determining regions/sequences (in which the amino acid residue at position 47 according to the Kabat numbering is chosen from the group consisting of W, L, F, A, G, I, M, R, S, V, and Y, and is preferably W, L, F or R); and/or:
- f) An amino acid sequence that is comprised of four framework regions/sequences interrupted by three complementarity determining regions/sequences (in which the amino acid residue at position 83 according to the Kabat numbering is chosen from the group consisting of R, K, N, E, G, I, M, Q and T, and is preferably K or R, and more preferably K); and/or:
- g) An amino acid sequence that is comprised of four framework regions/sequences interrupted by three complementarity determining regions/sequences (in which the amino acid residue at position 84 according to the Kabat numbering is chosen from the group consisting of P, A, L, R, S, T, D and V, and is preferably P); and/or:
- h) An amino acid sequence that is comprised of four framework regions/sequences interrupted by three complementarity determining regions/sequences (in which the amino acid residue at position 103 according to the Kabat numbering is chosen from the group consisting of W, P, R, and S, and is preferably and W); and/or:
- i) An amino acid sequence that is comprised of four framework regions/sequences interrupted by three complementarity determining regions/sequences (in which the amino acid residue at position 104 according to the Kabat numbering is G or D, and preferably G); and/or:
- j) An amino acid sequence that is comprised of four framework regions/sequences interrupted by three complementarity determining regions/sequences (in which the amino acid residue at position 108 according to the Kabat numbering is chosen from the group consisting of Q, L, and R, and is preferably Q or L).

More in particular, in one embodiment, a single domain antibody of the present invention can be defined as a polypeptide comprising an amino acid sequence that is comprised of four framework regions/sequences interrupted by three complementarity determining regions/sequences selected from the group consisting of k) to m) below:
- k) Amino acid residues at position 43 to 46 according to the Kabat numbering are KERE (SEQ ID NO: 540) or KQRE (SEQ ID NO: 541),
- l) Amino acid residues at position 44 to 47 according to the Kabat numbering are GLEW (SEQ ID NO: 542), and
- m) Amino acid residues at position 83 to 84 according to the Kabat numbering are KP or EP.

In one embodiment, "Humanized single domain antibody" herein refers to a chimeric single domain antibody comprising amino acid residues from CDR of non-human and human Framework. In one embodiment, in humanized single domain antibody all or substantially all CDRs can be corresponded to those of non-human antibody, and all or substantially all Framework can be corresponded to those of human antibody. In case that in humanized antibody a part of amino acid residues in Framework cannot be corresponded to those of human antibody, it is considered that substantially all Framework can be corresponded to those of human antibody. For instance, in case that VHH as one embodiment of a single domain antibody is humanized, it is required that a part of amino acid residues in Framework is converted to amino acid residues which are not corresponded to those of human antibody (C Vincke, etc., The Journal of Biological Chemistry 284, 3273-3284.)

In one embodiment of the present invention, the single-domain antibody is preferably a VHH, a VH having antigen binding activity by itself or a VL having antigen binding activity by itself. In the present specification, from another viewpoint, "a VH having antigen binding activity by itself" and "a VL having antigen binding activity by itself" can also be defined as "a single-domain antibody prepared from VH," and "a single-domain antibody prepared from VL", respectively.

In one embodiment, the antigen binding domain of the present invention may bind to a molecule present in a cartilage tissue. Further, in one embodiment, the antigen binding domain of the present invention may be a single-domain antibody or an antagonist. Moreover, in one embodiment, the single-domain antibody may be a VHH, a VH having antigen binding activity by itself or a VL having antigen binding activity by itself. Accordingly, in one embodiment, the antigen binding domain of the present invention may be a VHH, a VH having antigen binding activity by itself or a VL having antigen binding activity by itself that may bind to or recognize a molecule present in a cartilage tissue.

In the present specification, the "antigen" is limited only by containing an epitope to which the antigen binding domain binds. Preferred examples of the antigen include, but are not limited to, animal- or human-derived peptides, polypeptides, and proteins. Preferred examples of the antigen for use in the treatment of a disease caused by a target tissue include, but are not limited to, molecules expressed on the surface of target cells (e.g., cancer cells and inflammatory cells), molecules expressed on the surface of other cells in tissues containing target cells, molecules expressed on the surface of cells having an immunological role against target cells and tissues containing target cells, and large molecules present in the stromata of tissues containing target cells.

In one embodiment, antigens may be derived from any animal species (for example, human; or nonhuman animals such as mouse, rat, hamster, guinea pig, rabbit, monkey, cynomolgus monkey, Rhesus monkey, hamadryas baboon, chimpanzee, goat, sheep, dog, horse, pig, bovine, or camel), or any birds; and the antigens are preferably derived from human, monkey, rabbit, rat, or mouse.

The polypeptide of the present invention comprises an antigen binding domain that binds to a molecule present in a cartilage tissue.

In the present invention, any molecule present in a cartilage tissue can be exemplified as an antigen used in the present invention. In an embodiment, a molecule having longer half-life in a cartilage tissue is preferable as an antigen. Herein, the "half-life" of a molecule in refers to the time required for decreasing the number of the molecules present in the tissue to half. In general, tissues in a living body are maintained under a homeostatic regulation, and the number of molecules in a tissue is maintained nearly constant. Therefore, the "half-life" time of a molecule in a tissue means the time it takes for half of pre-existing molecules in the tissue is exchanged with new same molecules by metabolism. In one embodiment, the half-life of the molecule in the cartilage tissue used as an antigen in the present invention is 1 month or longer. Preferably, the half-life of the molecule is 2 month or longer, 3 month or longer, 4 month or longer, 5 month or longer, 6 month or longer, 8 month or longer, 10 month or longer, 12 month or longer, 1 year or longer, 2 year or longer, 3 year or longer, or 5 year or longer.

In one embodiment, the amount of the molecule used as an antigen in the present in a cartilage tissue is relatively high in the tissue. Herein, the "relative amount" of a molecule in refers to the weight of the molecule per unit weight of the tissue. The relative amount can be determined in % wet weight. For example, % wet weight of the molecule in the cartilage tissue used as an antigen in the present invention is 1% or more. Preferably, the relative amount of the molecule is 2% or more, 3% or more, 4% or more, 5% or more, 6% or more, 8% or more, 10% or more, 12% or more, 15% or more, 20% or more, or 25% or more. Examples of the method for determining % wet weight include, but are not limited to, Dimethylmethylene Blue Assay, Hydroxyproline Assay, mass spectrometry, and ELISA.

In one embodiment, the amount of the molecule used as an antigen in the present in a cartilage tissue can be, but not limited to, collagen, proteoglycan, glycoprotein, sugar chain, or other proteins.

In the present specification, collagen can be any type of collagen, including but not limited to: Collagen type II(fibrillar collagen), Collagen type III (fibrillar collagen), Collagen type IV, Collagen type V(fibrillar collagen), Collagen type VI, Collagen type IX, Collagen type X, Collagen type XI(fibrillar collagen), Collagen type XII, Collagen type XIV, Collagen type XVI, Collagen type XXII, Collagen type XXIV(fibrillar collagen), and Collagen type XXVII (fibrillar collagen).

Proteoglycan can be any type of proteoglycans, including but not limited to: Aggrecan, Vercican, Perlecan, Syndecan, Lubricin, Link protein, and Small leucine-rich repeat proteoglycans. Proteoglycan also includes Decorin, Biglycan, Asporin, Fibromodulin, Lumican, Keratocan, Osteoadherin, Proline-/arginine-rich end leucine-rich repeat protein, Epiphycan, Mimecan, Opticin, Chondroadherin, and Chondroadherin-like.

The molecule in the cartilage tissue used as an antigen in the present invention further includes a protein linked with proteoglycans selected from the group consisting of: Aggrecan, Vercican, Perlecan, Syndecan, and Lubricin.

The molecule in the cartilage tissue used as an antigen in the present invention can also be a sugar chain. Sugar chain includes, but not limited to, Hyaluronic acid (HA), Chondroitin sulfate (CS), Keratan sulfate (KS), and Dermatan sulfate (DS).

The molecule in the cartilage tissue used as an antigen in the present invention can also be extracellular matrix present in a cartilage tissue. Such extracellular matrix includes any type of extracellular matrix, including but not limited to, Thrombospondin, Matrilin, WARP, UCMA, CILP, Fibronectin, Lamin, and Nidgen. Aggrecan and collagen are preferred examples of the extracellular matrix used as an antigen in the present invention. Most preferably, aggrecan is used as an antigen.

The NCBI (National Center for Biotechnology Information, U.S. National Library of Medicine) database accession numbers for aggrecan are shown below:
human aggrecan, isoform 2: a nucleic acid sequence NM_013227.3, an amino acid sequence NP_037359.3
human aggrecan: isoform 1: a nucleic acid sequence NM_001135.3, an amino acid sequence NP_001126.3
mouse aggrecan: isoform 2: a nucleic acid sequence NM_007424.3, an amino acid sequence NP_031450.2
mouse aggrecan: isoform 1: a nucleic acid sequence NM_001361500.1, an amino acid sequence NP_001348429.1

In the present invention, aggrecan includes any isoforms, polymorphisms and valiants (including allelic variants and splicing variants) of aggrecan.

The antigen binding domain of the present invention has an activity to bind to the molecule as described above. Such binding domain can be prepared by using conventional techniques in the art. For example, an antigen binding domain for a target antigen can be prepared immunizing the antigen to animals to raise antibodies against the antigen.

The antigen binding domain of the present invention encompasses any binding domain which binds to the molecule as described above. Such antigen binding domain encompasses the binding domain of the antibodies which bind to the molecule as described above. The antigen binding domain of the present invention further encompasses a binding domain which competes for binding the epitope with an antibody which bind to the molecule as described above. For example, the antigen binding domain of the present invention competes for binding with the antibodies described below:
1) An antibody comprising VH sequence of SEQ ID NO: 512 and VL sequence of SEQ ID NO: 513,
2) An antibody comprising VH sequence of SEQ ID NO: 514 and VL sequence of SEQ ID NO: 515, and
3) An antibody comprising VH sequence of SEQ ID NO: 516 and VL sequence of SEQ ID NO: 517.

The antigen binding domain of the present invention may also be a binding domain that binds to an epitope within Aggrecan, wherein the antigen binding domain competes for binding the epitope with an antibody selected from the group consisting of 1)-3) below:
1) An antibody comprising VH sequence of SEQ ID NO: 512 and VL sequence of SEQ ID NO: 513, 2) An antibody comprising VH sequence of SEQ ID NO: 514 and VL sequence of SEQ ID NO: 515, and
3) An antibody comprising VH sequence of SEQ ID NO: 516 and VL sequence of SEQ ID NO: 517.

In one embodiment, the antigen binding domain of the present invention may also be a binding domain that binds to an epitope within amino acids at positions 377-386 of the amino acid sequence set forth in SEQ ID NO: 509 and competes for binding the epitope with an antibody selected from the group consisting of 1) below: 1) An antibody comprising VH sequence of SEQ ID NO: 512 and VL sequence of SEQ ID NO: 513.

In one embodiment, the antigen binding domain of the present invention may also be a binding domain that binds to an epitope within amino acids at positions 48-673 of the amino acid sequence set forth in SEQ ID NO: 509 and competes for binding the epitope with an antibody selected from the group consisting of 1) below: 1) An antibody comprising VH sequence of SEQ ID NO: 514 and VL sequence of SEQ ID NO: 515.

In one embodiment, the antigen binding domain of the present invention may also be a binding domain that binds to an epitope within amino acids at positions 48-673 of the amino acid sequence set forth in SEQ ID NO: 509 and competes for binding the epitope with an antibody selected from the group consisting of 1) below: 1) An antibody comprising VH sequence of SEQ ID NO: 516 and VL sequence of SEQ ID NO: 517.

The competition between the antigen binding domains can be detected by cross-blocking assay or the like. Competition can also be evaluated by competitive binding assays using means such as ELISA (competitive ELISA assay), fluorescence energy transfer method (FRET), and fluorometric microvolume assay technology (FMAT (registered trademark)). The competition of binding can also be confirmed by use of radiolabeled antigen binding assay (RIA), BIACORE (registered trademark) surface plasmon resonance assay, electrogenerated chemiluminescence, or the like, in addition to ELISA or FACS described above. An embodiment of competition assay is also described in detail below in the present specification.

In the present invention, the competition level for binding may be at least 10%, preferably at least 10%, more preferably at least 20 to 50%, more preferably at least 50% as compared with binding activity obtained in a control test carried out in the absence of the competitor. The antigen binding domains which compete with each other refer to antigen binding domains having the same or overlapping epitopes. The antigen binding domains which highly compete with each other refer to antigen binding domains having a substantially the same epitope. Blocking level of such antigen binding domains is, for example, 40% or more, or 45% or more.

In one embodiment, the antigen binding domain of the present invention is a binding domain which binds to a polypeptide comprising any one of the amino acid sequences below:
1) amino acids at positions 382-403 of the amino acid sequence set forth in SEQ ID NO: 509,
2) amino acids at positions 1669-1690 of the amino acid sequence set forth in SEQ ID NO: 509,
3) amino acids at positions 1838-1859 of the amino acid sequence set forth in SEQ ID NO: 509,
4) amino acids at positions 1943-1964 of the amino acid sequence set forth in SEQ ID NO: 509,
5) amino acids at positions 2043-2064 of the amino acid sequence set forth in SEQ ID NO: 509, and
6) amino acids at positions 2221-2242 of the amino acid sequence set forth in SEQ ID NO: 509.

In one embodiment, the antigen binding domain of the present invention is a binding domain which binds to a polypeptide comprising any one of the amino acid sequences below:
1) amino acids at positions 350-371, 393-414, 450-471, 666-687, 689-710, 943-964, 981-1002, 1000-1021, 1019-1040, 1038-1059, 1057-1078, 1076-1097, 1095-1116, 1114-1135, 1133-1154, 1152-1173, 1171-1192, 1190-1211, 1209-1230, 1228-1249, 1247-1268, 1266-1287, 1285-1306, 1304-1325, 1323-1344, 1342-1363, 1361-1382, 1380-1401, 1399-1420, 1437-1458, 1476-1497, 1514-1535, or 1575-1596 of the amino acid sequence set forth in SEQ ID NO: 509.

In one embodiment, the antigen binding domain of the present invention is a binding domain which binds to an epitope within Aggrecan, wherein the antigen binding domain competes for binding the epitope with the antibody below.
1) MAB1220 (R&D SYSTEMS, Monoclonal Mouse IgG2B Clone #179509).

In one embodiment, the antigen binding domain of the present invention is a binding domain which binds to an epitope within Aggrecan, wherein the antigen binding domain competes for binding an epitope within a polypeptide selected from the group consisting of 1) below:
1) amino acids at positions 48-673 (G1-IGD-G2 Domain) of the amino acid sequence set forth in SEQ ID NO: 509.

In one embodiment, the antigen binding domain of the present invention is a binding domain which comprises (a) a VH sequence having at least 95% sequence identity to the amino acid sequence of SEQ ID NO: 512 or 514 and/or (b) a VL sequence having at least 95% sequence identity to the amino acid sequence of SEQ ID NO: 513 or 515.

In one embodiment, the antigen binding domain of the present invention is a binding domain which comprises (a) a VH sequence having at least 95% sequence identity to the amino acid sequence of SEQ ID NO: 516 and/or (b) a VL sequence having at least 95% sequence identity to the amino acid sequence of SEQ ID NO: 517.

In one embodiment, the antigen binding domain of the present invention comprises any one of the combinations of H-chain CDR1, CDR2, and CDR3 and L-chain CDR1, CDR2, and CDR3 selected from 1) to 3) below, or any one of the combinations of H-chain CDR1, CDR2, and CDR3 and L-chain CDR1, CDR2, and CDR3 of antibody variable regions functionally equivalent thereto:
1) H-chain CDR1, CDR2, and CDR3 comprised in the antibody variable region are identical to the amino acid sequences of the CDR1, CDR2, and CDR3 regions comprised in SEQ ID NO:512; and L-chain CDR1, CDR2, and CDR3 comprised in the antibody variable region are identical to the amino acid sequences of the CDR1, CDR2, and CDR3 regions comprised in SEQ ID NO:513;
2) H-chain CDR1, CDR2, and CDR3 comprised in the antibody variable region are identical to the amino acid sequences of the CDR1, CDR2, and CDR3 regions comprised in SEQ ID NO:514; and L-chain CDR1, CDR2, and CDR3 comprised in the antibody variable region are identical to the amino acid sequences of the CDR1, CDR2, and CDR3 regions comprised in SEQ ID NO:515; and
3) H-chain CDR1, CDR2, and CDR3 comprised in the antibody variable region are identical to the amino acid sequences of the CDR1, CDR2, and CDR3 regions comprised in SEQ ID NO:516; and L-chain CDR1, CDR2, and CDR3 comprised in the antibody variable region are identical to the amino acid sequences of the CDR1, CDR2, and CDR3 regions comprised in SEQ ID NO:517.

In one embodiment, the antigen binding domain of the present invention comprises any one of the combinations of H-chain CDR1, CDR2, and CDR3 and L-chain CDR1, CDR2, and CDR3 of antibody variable regions selected from 1) to 3) below, or antibody variable regions functionally equivalent thereto:

1) An antibody H-chain variable region comprising the amino acid sequences of SEQ ID NO:512; and an antibody L-chain variable region comprising the amino acid sequences of SEQ ID NO:513;
2) An antibody H-chain variable region comprising the amino acid sequences of SEQ ID NO:514; and an antibody L-chain variable region comprising the amino acid sequences of SEQ ID NO:515; and
3) An antibody H-chain variable region comprising the amino acid sequences of SEQ ID NO:516; and an antibody L-chain variable region comprising the amino acid sequences of SEQ ID NO:517.

In one embodiment, the antigen can be a protease, such as, but not limited to ADAMTS4, ADAMTS5, and MMP-13. In one embodiment, the antigen is a protease, and the binding domain binds to the protease thereby inhibiting its activity. In one embodiment, the antigen binding domain binds to ADAMTS4, ADAMTS5, or MMP-13. In one embodiment, the binding domain binds to ADAMTS4, ADAMTS5, or MMP-13 thereby inhibiting its protease activity. In one specific embodiment, the binding domain binds to ADAMTS4, ADAMTS5, or MMP-13 thereby inhibiting the cleavage of aggrecan.

In another embodiment, the antigen binding domain binds to a proteolytic cleavage site of the antigen thereby inhibiting the cleavage of the antigen by the protease. In one embodiment, the antigen binding domain inhibits the cleavage of an antigen by ADAMTS4, ADAMTS5, or MMP-13. In one specific embodiment, the antigen binding domain binds to aggrecan and inhibits the cleavage of aggrecan by a protease such as ADAMTS4, ADAMTS5, or MMP-13.

The antigen binding domain of the present invention may recognize or bind to an epitope within an antigen. The epitope, which means an antigenic determinant, present in the antigen means a site on the antigen to which the antigen binding domain disclosed in the present specification binds. Accordingly, for example, the epitope can be defined by its structure. Alternatively, the epitope may be defined by the antigen-binding activity of the antigen binding domain recognizing the epitope. When the antigen is a peptide or a polypeptide, the epitope may be identified by amino acid residues constituting the epitope. When the epitope is a sugar chain, the epitope may be identified by a particular sugar chain structure.

A linear epitope refers to an epitope comprising an epitope that is recognized by its primary sequence of amino acids. The linear epitope contains typically at least 3 and most commonly at least 5, for example, approximately 8 to approximately 10 or 6 to 20 amino acids, in its unique sequence.

In contrast to the linear epitope, a conformational epitope refers to an epitope that is contained in a primary sequence of amino acids containing a component other than the single defined component of the epitope to be recognized (e.g., an epitope whose primary sequence of amino acids may not be recognized by an antibody that determines the epitope). The conformational epitope may contain an increased number of amino acids, as compared with the linear epitope. As for the recognition of the conformational epitope, the antigen binding domain recognizes the three-dimensional structure of the peptide or the protein. For example, when a protein molecule is folded to form a three-dimensional structure, certain amino acids and/or polypeptide backbone constituting the conformational epitope are arranged in parallel to allow the antibody to recognize the epitope. Examples of the method for determining the conformation of the epitope include, but are not limited to, X-ray crystallography, two-dimensional nuclear magnetic resonance spectroscopy, and site-specific spin labeling and electron paramagnetic resonance spectroscopy. See, for example, Epitope Mapping Protocols in Methods in Molecular Biology (1996), Vol. 66, Morris ed.

The structure of the antigen binding domain binding to the epitope is called paratope. The paratope stably binds to the epitope through a hydrogen bond, electrostatic force, van der Waals' forces, a hydrophobic bond, or the like acting between the epitope and the paratope. This binding force between the epitope and the paratope is called affinity. The total binding force when a plurality of antigen binding domains bind to a plurality of antigens is called avidity. The affinity works synergistically when, for example, an antibody comprising a plurality of antigen binding domains (i.e., a polyvalent antibody) bind to a plurality of epitopes. Therefore, the avidity is higher than the affinity.

In a particular embodiment, the antigen binding domain provided in the present specification has a dissociation constant (Kd) of 1 micro M or less, 100 nM or less, 10 nM or less, 1 nM or less, 0.1 nM or less, 0.01 nM or less or 0.001 nM or less (e.g., $10^{-8}$ M or less, for example, $10^{-8}$ M to $10^{-13}$ M, for example, $10^{-9}$ M to $10^{-13}$ M).

In a particular embodiment, the polypeptide, the antigen binding domain, the antibody, VHH, Fab and so on provided in the present specification can have a pI over 6. In a particular embodiment, the antigen binding domain can have a pI of more than 7, such as 7.1, 7.2, 7.3, 7.4, 7.5, 7.6, 7.7, 7.8, 7.9, 8.0 or even more, such as 8.1, 8.2, 8.3, 8.4, 8.5, 8.6, 8.7, 8.8, 8.9, 9.0 or even more, such as 9.1, 9, 2, 9.3, 9.4, 9.5, 9.6, 9.7, 9.8 or 9.9.

In an embodiment, pI of antibodies of the present invention can be measured by Maurice (proteinsimple). In a further embodiment, pI of antibodies of the present invention can be calculated by a method recited in Skoog, B. and Wichman, A. 1986. Calculation of the isoelectric points of polypeptides from the amino acid composition.trends in analytical chemistry, vol. 5, No. 4.

Hereinafter, an exemplary method for confirming the binding of an antigen binding domain directed to IL-6R, or a polypeptide comprising the antigen binding domain to the epitope will be shown. However, a method for confirming the binding of an antigen binding domain directed to an antigen other than IL-6R(for example, but are not limited to, collagen, proteoglycans, more specifically, aggrecan, glycoprotein, sugar chain and/or other proteins), or a polypeptide comprising the antigen binding domain to the epitope can also be appropriately carried out according to the example given below.

For example, whether the antigen binding domain directed to IL-6R recognizes a linear epitope present in the IL-6R molecule can be confirmed, for example, as follows: a linear peptide comprising an amino acid sequence constituting the extracellular domain of IL-6R is synthesized for the purpose described above. The peptide can be chemically synthesized. Alternatively, the peptide is obtained by a genetic engineering approach using a region encoding an amino acid sequence corresponding to the extracellular domain in IL-6R cDNA. Next, the antigen binding domain directed to IL-6R is evaluated for its binding activity against the linear peptide comprising an amino acid sequence constituting the extracellular domain. For example, the binding activity of the antigen binding domain against the peptide can be evaluated by ELISA using an immobilized linear peptide as an antigen. Alternatively, the binding activity against the linear peptide may be determined on the basis of a level at which the linear peptide inhibits the binding of the antigen binding domain to IL-6R-expressing cells. These tests can determine the binding activity of the antigen binding domain against the linear peptide.

In an embodiment, the antigen-binding domain of the present invention may bind to an epitope of aggrecan. An epitope sequence in an antigen can be obtained by epitope analysis techniques well-known to those skilled in the art. In an embodiment, the epitope of the present invention may be present within the G1-IGD-G2 domain of aggrecan. Further, in an embodiment, the epitope of the present invention may be located at a proteolytic cleavage site of aggrecan.

Also, whether the antigen binding domain directed to IL-6R recognizes the conformational epitope can be confirmed as follows: IL-6R-expressing cells are prepared for the purpose described above. The recognition of the conformational epitope by the antigen binding domain directed to IL-6R is confirmed, for example, when the antigen binding domain directed to IL-6R strongly binds to the IL-6R-expressing cells upon contact with the cells, whereas the antigen binding domain does not substantially bind to an immobilized linear peptide comprising an amino acid sequence constituting the extracellular domain of IL-6R or a denatured (using a general denaturant such as guanidine) linear peptide comprising an amino acid sequence constituting the extracellular domain of IL-6R. In this context, the term "not substantially bind" means that the binding activity is 80% or less, usually 50% or less, preferably 30% or less, particularly preferably 15% or less of binding activity against cells expressing human IL-6R.

The method for confirming the antigen binding activity of the antigen binding domain also includes a method of measuring a Kd value by, for example, radiolabeled antigen binding assay (RIA). In one embodiment, RIA is carried out using the antigen binding domain of interest and its antigen. For example, the binding affinity in a solution of the antigen binding domain for the antigen is measured by equilibrating the antigen binding domain with the smallest concentration of a (125I)-labeled antigen in the presence of a titration series of an unlabeled antigen, and subsequently capturing the bound antigen by a plate coated with the antigen binding domain (see e.g., Chen et al., J. Mol. Biol. 293: $865^{-881}$ (1999)).

According to an alternative embodiment, Kd is measured by a surface plasmon resonance method using BIACORE(R). For example, assay using BIACORE(R)-2000 or BIACORE(R)-3000 (BIAcore, Inc., Piscataway, NJ) is carried out at 25 degrees C. using a CM5 chip with approximately 10 response units (RU) of the antigen immobilized thereon. In one embodiment, a carboxymethylated dextran biosensor chip (CM5, BIAcore, Inc.) is activated using N-ethyl-N'-(3-dimethylaminopropyl)-carbodiimide hydrochloride (EDC) and N-hydroxysuccinimide (NHS) according to the supplier's instruction. The antigen is diluted to 5 micro g/ml (approximately 0.2 micro M) with 10 mM sodium acetate (pH 4.8) and then injected thereto at a flow rate of 5 micro 1/min so as to attain protein binding at approximately 10 response units (RU). After the antigen injection, 1 M ethanolamine is injected thereto in order to block unreacted groups. For kinetic measurement, 2-fold dilutions (0.78 nM to 500 nM) of the antigen binding domain in PBS containing 0.05% Polysorbate 20 (TWEEN-20(TM)) as a surfactant (PBST) are injected thereto at a flow rate of approximately 25 micro 1/min at 25 degrees C. An association rate (kon) and a dissociation rate (koff) are calculated by fitting sensorgrams of association and dissociation at the same time using a simple 1:1 Langmuir binding model (BIACORE(R) evaluation software version 3.2). An equilibrium dissociation constant (Kd) is calculated as a koff/kon ratio. Furthermore, an apparent dissociation constant (Kd) may be determined by use of equilibrium analysis. For these procedures, see the protocol attached to BIACORE(R). See, for example, Chen et al., J. Mol. Biol. 293: $865^{-881}$ (1999) and Methods Enzymol. 2000; 323: 325-40. In the surface plasmon resonance assay, the amount of the protein immobilized, the amount of the protein used in reaction, temperature, and solution composition can be variously changed by those skilled in the art. When the on-rate in the surface plasmon resonance assay described above exceeds 106 M-1s-1, the on-rate can be determined by use of a fluorescence quenching technique of using a spectrometer (e.g. a stopped-flow spectrophotometer (Aviv Instruments, Inc.) or SLM-AMINCO™ spectrophotometer 8000 series (Thermo Spectronic/Thermo Fisher Scientific Inc.) using a stirring cuvette) to measure increase or decrease in fluorescence intensity (excitation=295 nm; emission=340 nm, band path: 16 nm) at 25 degrees C. for 20 nM antigen binding domain in PBS (pH 7.2) in the presence of gradually increased concentrations of the antigen.

Furthermore, the antigen binding activity of the antigen binding domain can also be measured by a known molecule-molecule interaction measurement method such as electrogenerated chemiluminescence.

Examples of the method for measuring the binding activity of the antigen binding domain directed to IL-6R against the IL-6R-expressing cells include methods described in Antibodies: A Laboratory Manual (Ed Harlow, David Lane, Cold Spring Harbor Laboratory (1988) 359-420). Specifically, the binding activity can be evaluated on the basis of the principle of ELISA or FACS (fluorescence activated cell sorting) using the IL-6R-expressing cells as an antigen.

In the ELISA format, the binding activity of the antigen binding domain directed to IL-6R against the IL-6R-expressing cells is quantitatively evaluated by comparing the levels of signals generated through enzymatic reaction. Specifically, a test polypeptide associate is added to an ELISA plate with the IL-6R-expressing cells immobilized thereon. Then, the test antigen binding domain bound with the cells is detected through the use of an enzyme-labeled antibody recognizing the test antigen binding domain. Alternatively, in the FACS, a dilution series of a test antigen binding domain is prepared, and the antibody binding titer for the IL-6R-expressing cells can be determined to compare the binding activity of the test antigen binding domain against the IL-6R-expressing cells.

The binding of the test antigen binding domain to the antigen expressed on the surface of cells suspended in a buffer solution or the like can be detected using a flow cytometer. For example, the following apparatuses are known as the flow cytometer:

FACSCanto™ II
FACSAria™
FACSArray™
FACSVantage™ SE

FACSCalibur™ (all are trade names of BD Biosciences)
EPICS ALTRA HyPerSort
Cytomics FC 500
EPICS XL-MCL ADC EPICS XL ADC
Cell Lab Quanta/Cell Lab Quanta SC (all are trade names of Beckman Coulter, Inc.)

One preferred example of the method for measuring the antigen binding activity of the antigen binding domain directed to IL-6R includes the following method: first, IL-6R-expressing cells reacted with a test antigen binding domain are stained with a FITC-labeled secondary antibody recognizing the test antigen binding domain. The test antigen binding domain is appropriately diluted with a suitable buffer solution to prepare the antigen binding domain at the desired concentration for use. The antigen binding domain can be used, for example, at any concentration from 10 micro g/ml to 10 ng/ml. Next, fluorescence intensity and the number of cells are measured using FACSCalibur (Becton, Dickinson and Company). The amount of the antigen binding domain bound to the cells is reflected in the fluorescence intensity obtained by analysis using CELL QUEST Software (Becton, Dickinson and Company), i.e., a geometric mean value. In short, the binding activity of the test antigen binding domain indicated by the amount of the test antigen binding domain bound can be determined by obtaining the geometric mean value.

Whether the antigen binding domain directed to IL-6R shares an epitope with a certain antigen binding domain can be confirmed by the competition between these antigen binding domains for the same epitope. The competition between the antigen binding domains is detected by cross-blocking assay or the like. The cross-blocking assay is preferably, for example, competitive ELISA assay.

Specifically, in the cross-blocking assay, IL-6R protein-coated wells of a microtiter plate are preincubated in the presence or absence of a candidate competitor antigen binding domain. Then, a test antigen binding domain is added thereto. The amount of the test antigen binding domain bound with the IL-6R protein in the wells indirectly correlates with the binding capacity of the candidate competitor antigen binding domain that competes for the binding to the same epitope. In short, larger affinity of the competitor antigen binding domain for the same epitope means lower binding activity of the test antigen binding domain against the IL-6R protein-coated wells.

The amount of the test antigen binding domain bound with the wells via the IL-6R protein can be easily measured by labeling the antigen binding domain in advance. For example, a biotin-labeled antigen binding domain is assayed by using an avidin-peroxidase conjugate and an appropriate substrate. In particular, cross-blocking assay that utilizes enzyme labels such as peroxidase is called competitive ELISA assay. The antigen binding domain can be labeled with an alternative detectable or measurable labeling material. Specifically, radiolabels, fluorescent labels, and the like are known in the art.

Provided that the competitor antigen binding domain can block the binding of the antigen binding domain directed to IL-6R by at least 20%, preferably at least 20 to 50%, more preferably at least 50% as compared with binding activity obtained in a control test carried out in the absence of the candidate competitor antigen binding domain associate, the test antigen binding domain is determined as an antigen binding domain substantially binding to the same epitope as that for the competitor antigen binding domain, or competing for the binding to the same epitope.

When the epitope to which the antigen binding domain directed to IL-6R binds has an identified structure, whether a test antigen binding domain and a control antigen binding domain share an epitope can be evaluated by comparing the binding activity of these antigen binding domains against a peptide or a polypeptide prepared by introducing an amino acid mutation to a peptide constituting the epitope.

In such a method for measuring binding activity, for example, the binding activity of a test antigen binding domain and a control antigen binding domain against a linear peptide containing an introduced mutation can be compared in the ELISA format described above. In a method other than ELISA, the binding activity against the mutated peptide bound with a column may be measured by flowing the test antigen binding domain and the control antigen binding domain in the column, and then quantifying the antigen binding domain eluted in the eluate. A method for adsorbing a mutated peptide, for example, as a fusion peptide with GST, to a column is known in the art.

When the identified epitope is a conformational epitope, whether a test antigen binding domain and a control antigen binding domain share an epitope can be evaluated by the following method: first, IL-6R-expressing cells and cells expressing IL-6R with a mutation introduced to the epitope are prepared. The test antigen binding domain and the control antigen binding domain are added to cell suspensions containing these cells suspended in an appropriate buffer solution such as PBS. Subsequently, the cell suspensions are appropriately washed with a buffer solution, and a FITC-labeled antibody capable of recognizing the test antigen binding domain and the control antigen binding domain is then added thereto. The fluorescence intensity and the number of cells stained with the labeled antibody are measured using FACSCalibur (Becton, Dickinson and Company). The test antigen binding domain and the control antigen binding domain are appropriately diluted with a suitable buffer solution and used at concentrations thereby adjusted to the desired ones. These antigen binding domains are used, for example, at any concentration from 10 micro g/ml to 10 ng/ml. The amount of the labeled antibody bound to the cells is reflected in the fluorescence intensity obtained by analysis using CELL QUEST Software (Becton, Dickinson and Company), i.e., a geometric mean value. In short, the binding activity of the test antigen binding domain and the control antigen binding domain indicated by the amount of the labeled antibody bound can be determined by obtaining the geometric mean value.

The competition of the antigen binding domain with another antigen binding domain for the same epitope can also be confirmed by use of radiolabeled antigen binding assay (RIA), BIACORE(R) surface plasmon resonance assay, electrogenerated chemiluminescence, or the like, in addition to ELISA or FACS described above.

In the present method, whether to "not substantially bind to cells expressing mutated IL-6R" can be determined, for example, by the following method: first, a test antigen binding domain and a control antigen binding domain bound with the cells expressing mutated IL-6R are stained with a labeled antibody. Subsequently, the fluorescence intensity of the cells is detected. In the case of using FACSCalibur in the fluorescence detection by flow cytometry, the obtained fluorescence intensity can be analyzed using the CELL QUEST Software. From geometric mean values obtained in the presence and absence of the polypeptide associate, their comparison value (delta Geo-Mean) can be calculated according to expression 1 given below to determine the rate of increase in fluorescence intensity caused by the binding of the antigen binding domain.

delta Geo-Mean=Geo-Mean (in the presence of the polypeptide associate)/Geo-Mean (in the absence of the polypeptide associate)  (Expression 1)

The geometric mean comparison value (delta Geo-Mean value for the mutated IL-6R molecule) thus obtained by analysis, which reflects the amount of the test antigen binding domain bound with the cells expressing mutated IL-6R, is compared with the delta Geo-Mean comparison value that reflects the amount of the test antigen binding domain bound to the IL-6R-expressing cells. In this case, the concentrations of the test antigen binding domain used for determining the delta Geo-Mean comparison values for the cells expressing mutated IL-6R and the IL-6R-expressing cells are particularly preferably adjusted to equal or substantially equal concentrations. An antigen binding domain already confirmed to recognize an epitope in IL-6R is used as the control antigen binding domain.

Provided that the delta Geo-Mean comparison value of the test antigen binding domain for the cells expressing mutated IL-6R is smaller than at least 80%, preferably 50%, more preferably 30%, particularly preferably 15% of the delta Geo-Mean comparison value of the test antigen binding domain for the IL-6R-expressing cells, the test antigen binding domain "does not substantially bind to cells expressing mutate IL-6R". The calculation expression for determining the Geo-Mean (geometric mean) value is described in the CELL QUEST Software User's Guide (BD biosciences). The epitope for the test antigen binding domain and the control antigen binding domain can be assessed as being the same when their comparison values can be regarded as being substantially equivalent as a result of comparison.

In the present specification, the term "carrying moiety" refers to a moiety other than an antigen binding domain in a polypeptide. The carrying moiety of the present invention is usually a peptide or a polypeptide constituted by amino acids. In a specific embodiment, the carrying moiety in the polypeptide is linked to the antigen binding domain via a cleavage site. The carrying moiety of the present invention may be a series of peptides or polypeptides connected through an amide bond, or may be a complex formed from a plurality of peptides or polypeptides through a covalent bond such as a disulfide bond or a noncovalent bond such as a hydrogen bond or hydrophobic interaction.

The carrying moiety of the present invention has an inhibiting domain that inhibits the antigen binding activity of the antigen binding domain. In the present specification, the term "inhibiting domain" is limited only by the inhibition of the antigen binding activity of the antigen binding domain. The inhibiting domain can be a domain having any structure as long as the domain used can inhibit the antigen binding activity of the antigen binding domain. Examples of such an inhibiting domain include, but are not limited to, an antibody heavy chain variable region (VH), an antibody light chain variable region (VL), pre-B cell receptors, and single-domain antibodies. The inhibiting domain may constitute the whole of the carrying moiety or may constitute a portion of the carrying moiety.

In some embodiments of the present invention, the antigen binding domain released from the polypeptide has higher antigen binding activity than that before the release. In other words, the antigen binding activity of the antigen binding domain is inhibited by the inhibiting domain in a state where the antigen binding domain is unreleased from the polypeptide. Whether the antigen binding activity of the antigen binding domain is inhibited by the inhibiting domain is confirmed by a method such as FACS (fluorescence activated cell sorting), ELISA (enzyme-linked immunosorbent assay), ECL (electrogenerated chemiluminescence), a SPR (surface plasmon resonance) method (Biacore), BLI (biolayer interferometry) (Octet). In some embodiments of the present invention, the antigen binding activity of the antigen binding domain released from the polypeptide is a value equal to or larger than 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the binding activity of the antigen binding domain unreleased from the polypeptide. In some more specific embodiments of the present invention, the binding of the antigen binding domain before the release to the antigen is not seen when the antigen binding activity of the antigen binding domain is measured by one method selected from among the methods described above.

In some aspects of the present invention, the cleavage site is cleaved so that the antigen binding domain becomes capable of being released from the polypeptide. In such aspects, therefore, the antigen binding activity can be compared between before and after the cleavage of the polypeptide. Specifically, the antigen binding activity measured using the cleaved polypeptide is a value equal to or larger than 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the antigen binding activity measured using the uncleaved polypeptide. In some more specific embodiments, the binding of the antigen binding domain of the uncleaved polypeptide to the antigen is not seen when the antigen binding activity is measured by one method selected from among the methods described above.

In some aspects of the present invention, the cleavage site is cleaved by protease. In such aspects, therefore, the antigen binding activity can be compared between before and after the protease treatment of the polypeptide. Specifically, the antigen binding activity measured using the polypeptide after the protease treatment is a value equal to or larger than 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, 2000 times, or 3000 times the antigen binding activity measured using the polypeptide without the protease treatment. In some more specific embodiments, the binding of the antigen binding domain of the protease-untreated polypeptide to the antigen is not seen when the antigen binding activity is measured by one method selected from among the methods described above.

In some embodiments of the present invention, the antigen binding domain has a shorter half-life in blood than that of the carrying moiety. In one aspect, the half-life of the antigen binding domain present separated from the carrying moiety in blood is shorter than that of the antigen binding domain present with the carrying moiety in the polypeptide of the present invention. For example, the polypeptide comprising an antigen binding domain and a carrying moiety has a longer half-life in blood than the half-life of the antigen binding domain that exists alone. In some embodiments of the present invention, for the longer half-life of the polypeptide, the carrying moiety is designed so as to have a longer half-life in blood. In such embodiments, examples of the approach of extending the half-life in blood of the carrying moiety include, but are not limited to, a large molecular weight of the carrying moiety, FcRn binding activity possessed by the carrying moiety, albumin binding activity possessed by the carrying moiety, and the PEGylation of the carrying moiety. In some embodiments of the present invention, the carrying moiety has a longer half-life in blood than that of the antigen binding domain (in other words, the antigen binding domain has a shorter half-life in blood than the half-life of the carrying moiety).

In one embodiment, the half-life of the antigen binding domain present with the carrying moiety in the polypeptide of the present invention in blood is 10% or more longer (i.e., 1.1 times or more longer) than that of the antigen binding domain present separated from the carrying moiety in blood. In one embodiment, the half-life of the antigen binding domain present with the carrying moiety in the polypeptide of the present invention in blood is 20% or more, 30% or more, 40% or more, 50% or more, 60% or more, 70% or more, 80% or more, 90% or more, 100% or more, 200% or more, 300% or more, 500% or more, 1000% or more, 2000% or more, 3000% or more, 4000% or more, or 5000% or more longer than that of the antigen binding domain present separated from the carrying moiety in blood. In one embodiment, the half-life of the antigen binding domain present with the carrying moiety in the polypeptide of the present invention in blood is 2 times or more, 3 times or more, 4 times or more, 5 times or more, 6 times or more, 7 times or more, 8 times or more, 9 times or more, 10 times or more, 20 times or more, 30 times or more, or 50 times or more longer than that of the antigen binding domain present separated from the carrying moiety in blood.

In the present invention, the half-lives of the antigen binding domain alone and the polypeptide, or the half-lives in blood of the antigen binding domain and the carrying moiety are preferably compared in terms of their half-lives in blood in humans. If the half-lives in blood are difficult to measure in humans, the half-lives in blood in humans can be predicted on the basis of their half-lives in blood in mice (e.g., normal mice, transgenic mice expressing a human antigen, and transgenic mice expressing human FcRn) or monkeys (e.g., cynomolgus monkeys).

In one embodiment, the approach of extending the half-life in blood of the carrying moiety includes a large molecular weight of the carrying moiety. In one embodiment, the approach of rendering the half-life in blood of the carrying moiety longer than that of the antigen binding domain includes a larger molecular weight of the carrying moiety than that of the antigen binding domain.

In one embodiment, the approach of extending the half-life in blood of the carrying moiety includes FcRn binding activity possessed by the carrying moiety. The carrying moiety can usually possess FcRn binding activity by a method of establishing a FcRn binding region in the carrying moiety. The FcRn binding region refers to a region having binding activity against FcRn and may have any structure as long as the region used has binding activity against FcRn.

The carrying moiety containing a FcRn binding region is capable of being taken up into cells and then brought back into plasma through the salvage pathway of FcRn. For example, an IgG molecule has a relatively long circulation time in plasma (slow disappearance) because FcRn known as a salvage receptor of the IgG molecule functions. An IgG molecule taken up into the endosome through pinocytosis binds to FcRn expressed in the endosome under intraendosomal acidic conditions. An IgG molecule that has failed to bind to FcRn is moved to the lysosome and degraded therein, whereas the IgG molecule bound with FcRn is transferred to cell surface, then dissociated from the FcRn under neutral conditions in plasma, and thereby brought back into plasma.

The FcRn binding region is preferably a region binding directly to FcRn. Preferred examples of the FcRn binding region can include antibody Fc regions. However, a region capable of binding to a polypeptide, such as albumin or IgG, which has FcRn binding capacity is capable of binding indirectly to FcRn via albumin, IgG, or the like. Therefore, the FcRn binding region according to the present invention may be a region binding to such a polypeptide having FcRn binding capacity.

The binding activity of the FcRn binding region according to the present invention against FcRn, particularly, human FcRn may be measured by a method known to those skilled in the art, as mentioned in the above section about binding activity. The conditions therefor may be appropriately determined by those skilled in the art. The binding activity against human FcRn can be evaluated as KD (dissociation constant), apparent KD (apparent dissociation constant), kd (dissociation rate), or apparent kd (apparent dissociation rate), etc. These values can be measured by methods known to those skilled in the art. For example, Biacore (GE Healthcare Japan Corp.), Scatchard plot, a flow cytometer, and the like can be used.

The conditions for measuring the binding activity of the FcRn binding region against FcRn are not particularly limited and may be appropriately selected by those skilled in the art. The binding activity can be measured under conditions involving, for example, a MES buffer and 37 degrees C., as described in WO2009/125825. Also, the binding activity of the FcRn binding region of the present invention against FcRn may be measured by a method known to those skilled in the art and can be measured using, for example, Biacore (GE Healthcare Japan Corp.). In the measurement of the binding activity of the FcRn binding region against FcRn, FcRn and the FcRn binding region or the carrying moiety containing the FcRn binding region can be injected as analytes to chips on which the FcRn binding region or the carrying moiety containing the FcRn binding region and FcRn, respectively, are immobilized, followed by evaluation.

As for pH for use in the measurement conditions, the binding affinity of the FcRn binding region for FcRn may be evaluated at any pH of 4.0 to 6.5. Preferably, a pH of 5.8 to 6.0, which is close to pH in the early endosome in vivo, is used for determining the binding affinity of the FcRn binding region for human FcRn. As for temperature for use in the measurement conditions, the binding affinity of the FcRn binding region for FcRn may be evaluated at any temperature of 10 degrees C. to 50 degrees C. Preferably, a temperature of 15 degrees C. to 40 degrees C. is used for determining the binding affinity of the FcRn binding region for human FcRn. More preferably, any temperature from 20 degrees C. to 35 degrees C., for example, any one of 20, 21, 22, 23, 24, 25, 26, 27, 28, 29, 30, 31, 32, 33, 34, and 35 degrees C., is also used for determining the binding affinity of the FcRn binding region for FcRn. The temperature of 25 degrees C. is one non-limiting example of the temperature of the present invention.

One example of the FcRn binding region includes, but is not limited to, an IgG antibody Fc region. In the case of using an IgG antibody Fc region, its type is not limited, and for example, IgG1, IgG2, IgG3, or IgG4 Fc region may be used. For example, a Fc region containing one sequence selected from the amino acid sequences represented by SEQ ID NOs: 21, 22, 23, and 24 may be used.

A natural IgG antibody Fc region as well as an Fc region variant having one or more amino acid substitutions may be used as long as the Fc region has FcRn binding activity.

For example, an Fc region variant containing an amino acid sequence derived from an IgG antibody Fc region by the substitution of at least one amino acid selected from EU numbering positions 237, 238, 239, 248, 250, 252, 254, 255, 256, 257, 258, 265, 270, 286, 289, 297, 298, 303, 305, 307, 308, 309, 311, 312, 314, 315, 317, 325, 332, 334, 360, 376, 380, 382, 384, 385, 386, 387, 389, 424, 428, 433, 434 and 436 by another amino acid may be used.

More specifically, an Fc region variant containing at least one amino acid substitution selected from:
an amino acid substitution to substitute Gly at position 237 by Met,
an amino acid substitution to substitute Pro at position 238 by Ala,
an amino acid substitution to substitute Ser at position 239 by Lys,
an amino acid substitution to substitute Lys at position 248 by Ile,
an amino acid substitution to substitute Thr at position 250 by Ala, Phe, Ile, Met, Gln, Ser, Val, Trp, or Tyr,
an amino acid substitution to substitute Met at position 252 by Phe, Trp, or Tyr,
an amino acid substitution to substitute Ser at position 254 by Thr,
an amino acid substitution to substitute Arg at position 255 by Glu,
an amino acid substitution to substitute Thr at position 256 by Asp, Glu, or Gln,
an amino acid substitution to substitute Pro at position 257 by Ala, Gly, Ile, Leu, Met, Asn, Ser, Thr, or Val,
an amino acid substitution to substitute Glu at position 258 by His,
an amino acid substitution to substitute Asp at position 265 by Ala,
an amino acid substitution to substitute Asp at position 270 by Phe,
an amino acid substitution to substitute Asn at position 286 by Ala or Glu,
an amino acid substitution to substitute Thr at position 289 by His,
an amino acid substitution to substitute Asn at position 297 by Ala,
an amino acid substitution to substitute Ser at position 298 by Gly,
an amino acid substitution to substitute Val at position 303 by Ala,
an amino acid substitution to substitute Val at position 305 by Ala,
an amino acid substitution to substitute Thr at position 307 by Ala, Asp, Phe, Gly, His, Ile, Lys, Leu, Met, Asn, Pro, Gln, Arg, Ser, Val, Trp, or Tyr,
an amino acid substitution to substitute Val at position 308 by Ala, Phe, Ile, Leu, Met, Pro, Gln, or Thr,
an amino acid substitution to substitute Leu or Val at position 309 by Ala, Asp, Glu, Pro, or Arg,
an amino acid substitution to substitute Gln at position 311 by Ala, His, or Ile,
an amino acid substitution to substitute Asp at position 312 by Ala or His,
an amino acid substitution to substitute Leu at position 314 by Lys or Arg,
an amino acid substitution to substitute Asn at position 315 by Ala or His,
an amino acid substitution to substitute Lys at position 317 by Ala,
an amino acid substitution to substitute Asn at position 325 by Gly,
an amino acid substitution to substitute Ile at position 332 by Val,
an amino acid substitution to substitute Lys at position 334 by Leu,
an amino acid substitution to substitute Lys at position 360 by His,
an amino acid substitution to substitute Asp at position 376 by Ala,
an amino acid substitution to substitute Glu at position 380 by Ala,
an amino acid substitution to substitute Glu at position 382 by Ala,
an amino acid substitution to substitute Asn or Ser at position 384 by Ala,
an amino acid substitution to substitute Gly at position 385 by Asp or His,
an amino acid substitution to substitute Gln at position 386 by Pro,
an amino acid substitution to substitute Pro at position 387 by Glu,
an amino acid substitution to substitute Asn at position 389 by Ala or Ser,
an amino acid substitution to substitute Ser at position 424 by Ala,
an amino acid substitution to substitute Met at position 428 by Ala, Asp, Phe, Gly, His, Ile, Lys, Leu, Asn, Pro, Gln, Ser, Thr, Val, Trp, or Tyr,
an amino acid substitution to substitute His at position 433 by Lys,
an amino acid substitution to substitute Asn at position 434 by Ala, Phe, His, Ser, Trp, or Tyr, and
an amino acid substitution to substitute Tyr or Phe at position 436 by His (all according to the EU numbering) in an IgG antibody Fc region may be used.

From another viewpoint, a Fc region containing at least one amino acid selected from:
Met as the amino acid at position 237,
Ala as the amino acid at position 238,
Lys as the amino acid at position 239,
Ile as the amino acid at position 248,
Ala, Phe, Ile, Met, Gln, Ser, Val, Trp, or Tyr as the amino acid at position 250,
Phe, Trp, or Tyr as the amino acid at position 252,
Thr as the amino acid at position 254,
Glu as the amino acid at position 255,
Asp, Glu, or Gln as the amino acid at position 256,
Ala, Gly, Ile, Leu, Met, Asn, Ser, Thr, or Val as the amino acid at position 257,
His as the amino acid at position 258,
Ala as the amino acid at position 265,
Phe as the amino acid at position 270,
Ala or Glu as the amino acid at position 286,
His as the amino acid at position 289,
Ala as the amino acid at position 297,
Gly as the amino acid at position 298,
Ala as the amino acid at position 303,
Ala as the amino acid at position 305,
Ala, Asp, Phe, Gly, His, Ile, Lys, Leu, Met, Asn, Pro, Gln, Arg, Ser, Val, Trp, or Tyr as the amino acid at position 307, Ala, Phe, Ile, Leu, Met, Pro, Gln, or Thr as the amino acid at position 308,
Ala, Asp, Glu, Pro, or Arg as the amino acid at position 309,
Ala, His, or Ile as the amino acid at position 311,
Ala or His as the amino acid at position 312,
Lys or Arg as the amino acid at position 314,
Ala or His as the amino acid at position 315,
Ala as the amino acid at position 317,
Gly as the amino acid at position 325,
Val as the amino acid at position 332,
Leu as the amino acid at position 334,
His as the amino acid at position 360,
Ala as the amino acid at position 376,
Ala as the amino acid at position 380,
Ala as the amino acid at position 382,
Ala as the amino acid at position 384,
Asp or His as the amino acid at position 385,
Pro as the amino acid at position 386,
Glu as the amino acid at position 387,
Ala or Ser as the amino acid at position 389,
Ala as the amino acid at position 424,
Ala, Asp, Phe, Gly, His, Ile, Lys, Leu, Asn, Pro, Gln, Ser, Thr, Val, Trp, or Tyr as the amino acid at position 428,
Lys as the amino acid at position 433,
Ala, Phe, His, Ser, Trp, or Tyr as the amino acid at position 434, and
His as the amino acid at position 436
(all according to the EU numbering)
in an IgG antibody Fc region may be used.

The FcRn binding activity possessed by the carrying moiety does not mean that the antigen binding domain has no FcRn binding activity. In the embodiments in which the carrying moiety has a longer half-life in blood than the half-life of the antigen binding domain, the antigen binding domain may have no FcRn binding activity, as a matter of course, or the antigen binding domain may have FcRn binding activity as long as the FcRn binding activity is weaker than that of the carrying moiety.

In one embodiment, the method for extending the half-life in blood of the carrying moiety involves binding the carrying moiety to albumin. Since albumin does not undergo renal excretion and has FcRn binding activity, its half-life in blood is as long as 17 to 19 days (J Clin Invest. 1953 August; 32 (8): 746-768). Hence, it has been reported that a protein bound with albumin becomes bulky and capable of binding indirectly to FcRn and therefore has an increased half-life in blood (Antibodies 2015, 4 (3), 141-156).

In one embodiment, the alternative method for extending the half-life in blood of the carrying moiety involves PEGylating the carrying moiety. The PEGylation of a protein is considered to render the protein bulky and also suppress its degradation by protease in blood, thereby extending the half-life in blood of the protein (J Pharm Sci. 2008 October; 97 (10): 4167$^{-83}$).

In some embodiments of the present invention, the carrying moiety contains an antibody Fc region. In a specific embodiment, the carrying moiety contains a CH2 domain and a CH3 domain of a human IgG antibody. In a specific embodiment, the carrying moiety contains a moiety spanning from human IgG1 antibody heavy chain Cys226 or Pro230 to the carboxyl terminus of the heavy chain. However, the C-terminal lysine (Lys447) or glycine-lysine (Gly446-Lys447) of the Fc region may be present or absent.

In some embodiments of the present invention, the carrying moiety contains an antibody constant region. In a more preferred embodiment, the carrying moiety contains an IgG antibody constant region. In a further preferred embodiment, the carrying moiety contains a human IgG antibody constant region.

In some embodiments of the present invention, the carrying moiety contains: a region substantially similar in structure to an antibody heavy chain constant region; and a region substantially similar in structure to an antibody light chain, connected to the region via a covalent bond such as a disulfide bond or a noncovalent bond such as a hydrogen bond or hydrophobic interaction.

In the present specification, the "polypeptide comprising an antigen binding domain and a carrying moiety" is usually a series of polypeptides connected through an amide bond, or a protein containing a plurality of polypeptides connected through an amide bond.

In some embodiments of the present invention, the antigen binding domain is capable of being released from the polypeptide, and the antigen binding domain released from the polypeptide has higher antigen binding activity. In the present specification, the term "release" refers to the mutual separation of two moieties of the polypeptide. The release of the antigen binding domain from the polypeptide can be attributed to the cancelation of the interaction between the antigen binding domain and the carrying moiety. The antigen binding activity of the antigen binding domain incorporated in the polypeptide is inhibited. Hence, the antigen binding domain released from the polypeptide can be confirmed by measuring the antigen binding activity of a subject and comparing it with the antigen binding activity of the antigen binding domain incorporated in the polypeptide.

In some embodiments, the polypeptide comprises a cleavage site, and the cleavage site is cleaved so that the antigen binding domain is released from the polypeptide. The cleavage site can be cleaved by, for example, an enzyme, can be reduced with a reducing agent, or can be photodegraded. The cleavage site may be placed at any position in the polypeptide as long as the antigen binding domain can be released and does not lose its antigen binding activity after the release. The polypeptide may further contain an additional cleavage site other than the cleavage site for the release of the antigen binding domain. In one embodiment of the present invention, the cleavage site comprises a protease cleavage sequence and can be cleaved by protease.

In the present specification, the term "cleaved" refers to a state where the antigen binding domain and the carrying moiety are separated from each other after alteration of the cleavage site by protease, reduction of a cysteine-cysteine disulfide bond at the cleavage site, and/or photoactivation, etc. In the present specification, the term "uncleaved" refers to a state where the antigen binding domain is linked to the carrying moiety in the absence of the protease cleavage of the cleavage site, in the absence of the reduction of a cysteine-cysteine disulfide bond at the cleavage site, and/or in the absence of light, etc.

The cleavage of the cleavage site can be detected by subjecting a solution containing the cleavage site-containing polypeptide to SDS-PAGE (polyacrylamide gel electrophoresis) and measuring the molecular weights of the fragments or detecting change in molecular weight between before and after the cleavage.

The cleavage site can be specifically modified (cleaved, reduced or photodegraded) by an agent (i.e., protease, a reducing agent, or light) at a rate of approximately 0.001 to 1500×104 M-1S-1 or at least 0.001, 0.005, 0.01, 0.05, 0.1, 0.5, 1, 2.5, 5, 7.5, 10, 15, 20, 25, 50, 75, 100, 125, 150, 200, 250, 500, 750, 1000, 1250, or 1500×104 M-1S-1.

The specific cleavage by protease is performed by the contact between the protease and the cleavage site or a molecule containing the cleavage site. The cleavage site can be cleaved in the presence of sufficient enzyme activity. The sufficient enzyme activity can refer to the ability of the enzyme to bring about cleavage upon contact with the cleavage site.

In the present specification, the term "protease" refers to an enzyme such as endopeptidase or exopeptidase which hydrolyzes a peptide bond, typically, endopeptidase. The protease used in the present invention is limited only by being capable of cleaving the protease cleavage sequence and is not particularly limited by its type. In some embodiments, target tissue specific protease is used. The target tissue specific protease can refer to, for example, any of:

(1) protease that is expressed at a higher level in the target tissue than in normal tissues,
(2) protease that has higher activity in the target tissue than in normal tissues,
(3) protease that is expressed at a higher level in the target cells than in normal cells, and
(4) protease that has higher activity in the target cells than in normal cells.

In a more specific embodiment, a cancer tissue specific protease or an inflammatory tissue specific protease is used.

In the present specification, the term "target tissue" means a tissue containing at least one target cell. In some embodiments of the present invention, the target tissue is a cancer tissue. In some embodiments of the present invention, the target tissue is an inflammatory tissue.

The term "cancer tissue" means a tissue containing at least one cancer cell. Thus, considering that, for example, the cancer tissue contains cancer cells and vascular vessels, every cell type that contributes to the formation of tumor mass containing cancer cells and endothelial cells is included in the scope of the present invention. In the present specification, the tumor mass refers to a foci of tumor tissue. The term "tumor" is generally used to mean benign neoplasm or malignant neoplasm.

In the present specification, examples of the "inflammatory tissue" include the following:
 a joint tissue in rheumatoid arthritis or osteoarthritis,
 a lung (alveolus) tissue in bronchial asthma or COPD,
 a digestive organ tissue in inflammatory bowel disease, Crohn disease, or ulcerative colitis,
 a fibrotic tissue in fibrosis in the liver, the kidney, or the lung,
 a tissue under rejection of organ transplantation,
 a vascular vessel or heart (cardiac muscle) tissue in arteriosclerosis or heart failure,
 a visceral fat tissue in metabolic syndrome,
 a skin tissue in atopic dermatitis and other dermatitides, and
 a spinal nerve tissue in disk herniation or chronic lumbago.

Specifically expressed or specifically activated protease, or protease considered to be related to the disease condition of a target tissue (target tissue specific protease) is known for some types of target tissues. For example, International Publication Nos. WO2013/128194, WO2010/081173, and WO2009/025846 disclose protease specifically expressed in a cancer tissue. Also, J Inflamm (Lond). 2010; 7: 45, Nat Rev Immunol. 2006 July; 6 (7): 541-50, Nat Rev Drug Discov. 2014 December; 13 (12): 904-27, Respir Res. 2016 Mar. 4; 17: 23, Dis Model Mech. 2014 February; 7 (2): 193-203, and Biochim Biophys Acta. 2012 January; 1824 (1): 133-45 disclose protease considered to be related to inflammation.

In addition to the protease specifically expressed in a target tissue, there also exists protease specifically activated in a target tissue. For example, protease may be expressed in an inactive form and then converted to an active form. Many tissues contain a substance inhibiting active protease and control the activity by the process of activation and the presence of the inhibitor (Nat Rev Cancer. 2003 July; 3 (7): 489-501). In a target tissue, the active protease may be specifically activated by escaping inhibition.

The active protease can be measured by use of a method using an antibody recognizing the active protease (PNAS 2013 Jan 2; 110 (1): 93-98) or a method of fluorescently labeling a peptide recognizable by protease so that the fluorescence is quenched before cleavage, but emitted after cleavage (Nat Rev Drug Discov. 2010 September; 9 (9): 690-701. doi: 10.1038/nrd3053).

From one viewpoint, the term "target tissue specific protease" can refer to any of:

(i) protease that is expressed at a higher level in the target tissue than in normal tissues,
(ii) protease that has higher activity in the target tissue than in normal tissues,
(iii) protease that is expressed at a higher level in the target cells than in normal cells, and
(iv) protease that has higher activity in the target cells than in normal cells.

Specific examples of the protease include, but are not limited to, cysteine protease (including cathepsin families B, L, S, etc.), aspartyl protease (cathepsins D, E, K, O, etc.), serine protease (including matriptase (including MT-SP1), cathepsins A and G, thrombin, plasmin, urokinase (uPA), tissue plasminogen activator (tPA), elastase, proteinase 3, thrombin, kallikrein, tryptase, and chymase), metalloproteinase (metalloproteinase (MMP1-28) including both membrane-bound forms (MMP14-17 and MMP24-25) and secreted forms (MMP1-13, MMP18-23 and MMP26-28), specifically MMP1, MMP2, MMP3, MMP7, MMP9, MMP13, and MMP14, A disintegrin and metalloproteinase (ADAM), specifically ADAM17, A disintegrin and metalloproteinase with thrombospondin motifs (ADAMTSs (ADAMTS1, ADAMTS2, ADAMTS3, ADAMTS4, ADAMTS5, ADAMTS6, ADAMTS7, ADAMTS8, ADAMTS9, ADAMTS10, ADAMTS12, ADAMTS13, ADAMTS14, ADAMTS15, ADAMTS16, ADAMTS17, ADAMTS18, ADAMTS19 and ADAMTS20)), specifically ADAMTS4 and ADAMTS5, meprin (meprin alpha and meprin beta), CD10 (CALLA), prostate-specific antigen (PSA), legumain, TMPRSS3, TMPRSS4, human neutrophil elastase (HNE), beta secretase (BACE), fibroblast activation protein alpha (FAP), granzyme B, guanidinobenzoatase (GB), hepsin, neprilysin, NS3/4A, HCV-NS3/4, calpain, ADAMDEC1, renin, cathepsin C, cathepsin V/L2, cathepsin X/Z/P, cruzipain, otubain 2, kallikrein-related peptidases (KLKs (KLK3, KLK4, KLK5, KLK6, KLK7, KLK8, KLK10, KLK11, KLK13, and KLK14)), bone morphogenetic protein 1 (BMP-1), activated protein C, blood coagulation-related protease (Factor VIIa, Factor IXa, Factor Xa, Factor XIa, and Factor XIIa), HtrA1, lactoferrin, marapsin, PACE4, DESC1, dipeptidyl peptidase 4 (DPP-4), TMPRSS2, cathepsin F, cathepsin H, cathepsin L2, cathepsin 0, cathepsin S, granzyme A, Gepsin calpain 2, glutamate carboxypeptidase 2, AMSH-like proteases, AMSH, gamma secretase, antiplasmin cleaving enzyme (APCE), decysin 1, N-acetylated alpha-linked acidic dipeptidase-like 1 (NAALADL1), and furin.

From another viewpoint, the target tissue specific protease can refer to a cancer tissue specific protease or an inflammatory tissue specific protease.

Examples of cancer tissue specific protease include protease specifically expressed in a cancer tissue disclosed in International Publication Nos. WO2013/128194, WO2010/081173, and WO2009/025846.

As for the type of cancer tissue specific protease, the protease having higher expression specificity in the cancer tissue to be treated is more effective for reducing adverse reactions. Preferable cancer tissue specific protease has a concentration in the cancer tissue at least 5 times, more preferably at least 10 times, further preferably at least 100 times, particularly preferably at least 500 times, most preferably at least 1000 times higher than its concentration in normal tissues. Also, preferable cancer tissue specific protease has activity in the cancer tissue at least 2 times, more preferably at least 3 times, at least 4 times, at least 5 times, or at least 10 times, further preferably at least 100 times, particularly preferably at least 500 times, most preferably at least 1000 times higher than its activity in normal tissues.

The cancer tissue specific protease may be in a form bound with a cancer cell membrane or may be in a form secreted extracellularly without being bound with a cell membrane. When the cancer tissue specific protease is not bound with a cancer cell membrane, it is preferred for immunocyte-mediated cytotoxicity specific for cancer cells that the cancer tissue specific protease should exist within or in the vicinity of the cancer tissue. In the present specification, the "vicinity of the cancer tissue" means to fall within the scope of location where the protease cleavage sequence specific for the cancer tissue is cleaved so that the antigen binding domain exerts antigen binding activity. However, it is preferred that damage on normal cells should be minimized in this scope of location.

From an alternative viewpoint, cancer tissue specific protease is any of:
  (i) protease that is expressed at a higher level in the cancer tissue than in normal tissues,
  (ii) protease that has higher activity in the cancer tissue than in normal tissues,
  (iii) protease that is expressed at a higher level in the cancer cells than in normal cells, and
  (iv) protease that has higher activity in the cancer cells than in normal cells.

One type of cancer tissue specific protease may be used alone, or two or more types of cancer tissue specific proteases may be combined. The number of types of cancer tissue specific protease can be appropriately set by those skilled in the art in consideration of the cancer type to be treated.

From these viewpoints, cancer tissue specific protease is preferably serine protease or metalloproteinase, more preferably matriptase (including MT-SP1), urokinase (uPA), or metalloproteinase, further preferably MT-SP1, uPA, MMP2, or MMP9, among the proteases listed above.

As for the type of inflammatory tissue specific protease, the protease having higher expression specificity in the inflammatory tissue to be treated is more effective for reducing adverse reactions. Preferable inflammatory tissue specific protease has a concentration in the inflammatory tissue at least 5 times, more preferably at least 10 times, further preferably at least 100 times, particularly preferably at least 500 times, most preferably at least 1000 times higher than its concentration in normal tissues. Also, preferable inflammatory tissue specific protease has activity in the inflammatory tissues at least 2 times, more preferably at least 3 times, at least 4 times, at least 5 times, or at least 10 times, further preferably at least 100 times, particularly preferably at least 500 times, most preferably at least 1000 times higher than its activity in normal tissues.

The inflammatory tissue specific protease may be in a form bound with an inflammatory cell membrane or may be in a form secreted extracellularly without being bound with a cell membrane. When the inflammatory tissue specific protease is not bound with an inflammatory cell membrane, it is preferred for immunocyte-mediated cytotoxicity specific for inflammatory cells that the inflammatory tissue specific protease should exist within or in the vicinity of the inflammatory tissue. In the present specification, the "vicinity of the inflammatory tissue" means to fall within the scope of location where the protease cleavage sequence specific for the inflammatory tissue is cleaved so that the antigen binding domain exerts antigen binding activity. However, it is preferred that damage on normal cells should be minimized in this scope of location.

From an alternative viewpoint, inflammatory tissue specific protease is any of:
  (i) protease that is expressed at a higher level in the inflammatory tissue than in normal tissues,
  (ii) protease that has higher activity in the inflammatory tissue than in normal tissues,
  (iii) protease that is expressed at a higher level in the inflammatory cells than in normal cells, and
  (iv) protease that has higher activity in the inflammatory cells than in normal cells.

One type of inflammatory tissue specific protease may be used alone, or two or more types of inflammatory tissue specific proteases may be combined. The number of types of inflammatory tissue specific protease can be appropriately set by those skilled in the art in consideration of the pathological condition to be treated.

From these viewpoints, inflammatory tissue specific protease is preferably metalloproteinase among the proteases listed above. The metalloproteinase is more preferably ADAMTS4, ADAMTS5, ADAM17, MMP2, MMP7, MMP9, MMP13, or MMP14.

The protease cleavage sequence is a particular amino acid sequence that is specifically recognized by target tissue specific protease when the polypeptide is hydrolyzed by the target tissue specific protease in an aqueous solution.

The protease cleavage sequence is preferably an amino acid sequence that is hydrolyzed with high specificity by target tissue specific protease more specifically expressed in the target tissue or cells to be treated or more specifically activated in the target tissue/cells to be treated, from the viewpoint of reduction in adverse reactions.

Specific examples of the protease cleavage sequence include target sequences that are specifically hydrolyzed by the above-listed protease specifically expressed in a cancer tissue disclosed in International Publication Nos. WO2013/128194, WO2010/081173, and WO2009/025846, the protease specific for an inflammatory tissue, and the like. A sequence artificially altered by, for example, introducing an appropriate amino acid mutation to a target sequence that is specifically hydrolyzed by known protease can also be used. Alternatively, a protease cleavage sequence identified by a method known to those skilled in the art as described in Nature Biotechnology 19, 661-667 (2001) may be used.

Furthermore, a naturally occurring protease cleavage sequence may be used. For example, TGF beta is converted to a latent form by protease cleavage. Likewise, a protease cleavage sequence in a protein that changes its molecular form by protease cleavage can also be used.

Examples of the protease cleavage sequence that can be used include, but are not limited to, sequences disclosed in International Publication No. WO2015/116933, International Publication No. WO2015/048329, International Publication No. WO2016/118629, International Publication No. WO2016/179257, International Publication No. WO2016/179285, International Publication No. WO2016/179335, International Publication No. WO2016/179003, International Publication No. WO2016/046778, International Publication No. WO2016/014974, U.S. Patent Publication No. US2016/0289324, U.S. Patent Publication No. US2016/0311903, PNAS (2000) 97: 7754-7759, Biochemical Journal (2010) 426: 219-228, and Beilstein J Nanotechnol. (2016) 7: 364-373.

The protease cleavage sequence is more preferably an amino acid sequence that is specifically hydrolyzed by suitable target tissue specific protease as mentioned above. The amino acid sequence that is specifically hydrolyzed by target tissue specific protease is preferably a sequence comprising any of the following amino acid sequences:

LSGRSDNH (SEQ ID NO: 12, cleavable by MT-SP1 or uPA),
PLALAG (SEQ ID NO: 25, cleavable by MMP2 or MMP9), and
VPLSLTMG (SEQ ID NO: 26, cleavable by MMP7).

Any of the following sequences can also be used as the protease cleavage sequence:

TSTSGRSANPRG (SEQ ID NO: 74, cleavable by MT-SP1 or uPA),
ISSGLLSGRSDNH (SEQ ID NO: 75, cleavable by MT-SP1 or uPA),
AVGLLAPPGGLSGRSDNH (SEQ ID NO: 76, cleavable by MT-SP1 or uPA),
GAGVPMSMRGGAG (SEQ ID NO: 77, cleavable by MMP1),
GAGIPVSLRSGAG (SEQ ID NO: 78, cleavable by MMP2),
GPLGIAGQ (SEQ ID NO: 79, cleavable by MMP2),
GGPLGMLSQS (SEQ ID NO: 80, cleavable by MMP2),
PLGLWA (SEQ ID NO: 81, cleavable by MMP2),
GAGRPFSMIMGAG (SEQ ID NO: 82, cleavable by MMP3),
GAGVPLSLTMGAG (SEQ ID NO: 83, cleavable by MMP7),
GAGVPLSLYSGAG (SEQ ID NO: 84, cleavable by MMP9),
AANLRN (SEQ ID NO: 85, cleavable by MMP11),
AQAYVK (SEQ ID NO: 86, cleavable by MMP11),
AANYMR (SEQ ID NO: 87, cleavable by MMP11),
AAALTR (SEQ ID NO: 88, cleavable by MMP11),
AQNLMR (SEQ ID NO: 89, cleavable by MMP11),
AANYTK (SEQ ID NO: 90, cleavable by MMP11),
GAGPQGLAGQRGIVAG (SEQ ID NO: 91, cleavable by MMP13),
PRFKIIGG (SEQ ID NO: 92, cleavable by pro-urokinase),
PRFRIIGG (SEQ ID NO: 93, cleavable by pro-urokinase),
GAGSGRSAG (SEQ ID NO: 94, cleavable by uPA),
SGRSA (SEQ ID NO: 95, cleavable by uPA),
GSGRSA (SEQ ID NO: 96, cleavable by uPA),
SGKSA (SEQ ID NO: 97, cleavable by uPA),
SGRSS (SEQ ID NO: 98, cleavable by uPA),
SGRRA (SEQ ID NO: 99, cleavable by uPA),
SGRNA (SEQ ID NO: 100, cleavable by uPA),
SGRKA (SEQ ID NO: 101, cleavable by uPA),
QRGRSA (SEQ ID NO: 102, cleavable by tPA),
GAGSLLKSRMVPNFNAG (SEQ ID NO: 103, cleavable by cathepsin B)
TQGAAA (SEQ ID NO: 104, cleavable by cathepsin B),
GAAAAA (SEQ ID NO: 105, cleavable by cathepsin B),
GAGAAG (SEQ ID NO: 106, cleavable by cathepsin B),
AAAAAG (SEQ ID NO: 107, cleavable by cathepsin B),
LCGAAI (SEQ ID NO: 108, cleavable by cathepsin B),
FAQALG (SEQ ID NO: 109, cleavable by cathepsin B),
LLQANP (SEQ ID NO: 110, cleavable by cathepsin B),
LAAANP (SEQ ID NO: 111, cleavable by cathepsin B),
LYGAQF (SEQ ID NO: 112, cleavable by cathepsin B),
LSQAQG (SEQ ID NO: 113, cleavable by cathepsin B),
ASAASG (SEQ ID NO: 114, cleavable by cathepsin B),
FLGASL (SEQ ID NO: 115, cleavable by cathepsin B),
AYGATG (SEQ ID NO: 116, cleavable by cathepsin B),
LAQATG (SEQ ID NO: 117, cleavable by cathepsin B),
GAGSGVVIATVIVITAG (SEQ ID NO: 118, cleavable by cathepsin L),
APMAEGGG (SEQ ID NO: 119, cleavable by meprin alpha or meprin beta),
EAQGDKII (SEQ ID NO: 120, cleavable by meprin alpha or meprin beta),
LAFSDAGP (SEQ ID NO: 121, cleavable by meprin alpha or meprin beta),
YVADAPK (SEQ ID NO: 122, cleavable by meprin alpha or meprin beta),
RRRRR (SEQ ID NO: 123, cleavable by furin),
RRRRRR (SEQ ID NO: 124, cleavable by furin),
GQSSRHRRAL (SEQ ID NO: 125, cleavable by furin),
SSRHRRALD (SEQ ID NO: 126),
RKSSIIIRMRDVVL (SEQ ID NO: 127, cleavable by plasminogen),
SSSFDKGKYKKGDDA (SEQ ID NO: 128, cleavable by staphylokinase),
SSSFDKGKYKRGDDA (SEQ ID NO: 129, cleavable by staphylokinase),
IEGR (SEQ ID NO: 130, cleavable by Factor Xa),
IDGR (SEQ ID NO: 131, cleavable by Factor Xa),
GGSIDGR (SEQ ID NO: 132, cleavable by Factor Xa),
GPQGIAGQ (SEQ ID NO: 133, cleavable by collagenase),
GPQGLLGA (SEQ ID NO: 134, cleavable by collagenase),
GIAGQ (SEQ ID NO: 135, cleavable by collagenase),
GPLGIAG (SEQ ID NO: 136, cleavable by collagenase),
GPEGLRVG (SEQ ID NO: 137, cleavable by collagenase),
YGAGLGVV (SEQ ID NO: 138, cleavable by collagenase),
AGLGVVER (SEQ ID NO: 139, cleavable by collagenase),
AGLGISST (SEQ ID NO: 140, cleavable by collagenase),
EPQALAMS (SEQ ID NO: 141, cleavable by collagenase),
QALAMSAI (SEQ ID NO: 142, cleavable by collagenase),
AAYHLVSQ (SEQ ID NO: 143, cleavable by collagenase),
MDAFLESS (SEQ ID NO: 144, cleavable by collagenase),
ESLPVVAV (SEQ ID NO: 145, cleavable by collagenase),
SAPAVESE (SEQ ID NO: 146, cleavable by collagenase), DVAQFVLT (SEQ ID NO: 147, cleavable by collagenase),
VAQFVLTE (SEQ ID NO: 148, cleavable by collagenase),
AQFVLTEG (SEQ ID NO: 149, cleavable by collagenase),
PVQPIGPQ (SEQ ID NO: 150, cleavable by collagenase),
LVPRGS (SEQ ID NO: 151, cleavable by thrombin),
TSTSGRSANPRG (SEQ ID NO: 178, cleavable by uPA or MT-SP1), and
GPPGPQGLAGQRGIVGL (SEQ ID NO: 536, cleavable by MMP13).

In one embodiment of the present invention, a flexible linker is further attached to either one end or both ends of the protease cleavage sequence. The flexible linker at one end of the protease cleavage sequence can be referred to as a first flexible linker, and the flexible linker at the other end can be referred to as a second flexible linker. In a particular embodiment, the protease cleavage sequence and the flexible linker have any of the following formulas:
(protease cleavage sequence),
(first flexible linker)-(protease cleavage sequence),
(protease cleavage sequence)-(second flexible linker), and
(first flexible linker)-(protease cleavage sequence)-(second flexible linker).

The flexible linker according to the present embodiment is preferably a peptide linker. The first flexible linker and the second flexible linker each independently and arbitrarily exist and are identical or different flexible linkers each containing at least one flexible amino acid (Gly, etc.). The flexible linker contains, for example, a sufficient number of residues (amino acids arbitrarily selected from Arg, Ile, Gln, Glu, Cys, Tyr, Trp, Thr, Val, His, Phe, Pro, Met, Lys, Gly, Ser, Asp, Asn, Ala, etc., particularly Gly, Ser, Asp, Asn, and Ala, in particular, Gly and Ser, especially Gly, etc.) for the protease cleavage sequence to obtain the desired protease accessibility.

The flexible linker suitable for use at both ends of the protease cleavage sequence is usually a flexible linker that improves the access of protease to the protease cleavage sequence and elevates the cleavage efficiency of the protease. A suitable flexible linker may be readily selected and can be preferably selected from among different lengths such as 1 amino acid (Gly, etc.) to 20 amino acids, 2 amino acids to 15 amino acids, or 3 amino acids to 12 amino acids including 4 amino acids to 10 amino acids, 5 amino acids to 9 amino acids, 6 amino acids to 8 amino acids, or 7 amino acids to 8 amino acids. In some embodiments of the present invention, the flexible linker is a peptide linker of 1 to 7 amino acids.

Examples of the flexible linker include, but are not limited to, glycine polymers (G)n, glycine-serine polymers (including e.g., (GS)n, (GSGGS: SEQ ID NO: 27)n and (GGGS: SEQ ID NO: 28)n, wherein n is an integer of at least 1), glycine-alanine polymers, alanine-serine polymers, and other flexible linkers well known in conventional techniques.

Among them, glycine and glycine-serine polymers are receiving attention because these amino acids are relatively unstructured and easily function as neutral tethers between components.

Examples of the flexible linker consisting of the glycine-serine polymer include, but are not limited to,
Ser
Gly Ser (GS)
Ser Gly (SG)
Gly Gly Ser (GGS)
Gly Ser Gly (GSG)
Ser Gly Gly (SGG)
Gly Ser Ser (GSS)
Ser Ser Gly (SSG)
Ser Gly Ser (SGS)
Gly Gly Gly Ser (GGGS, SEQ ID NO: 28)
Gly Gly Ser Gly (GGSG, SEQ ID NO: 29)
Gly Ser Gly Gly (GSGG, SEQ ID NO: 46)
Ser Gly Gly Gly (SGGG, SEQ ID NO: 47)
Gly Ser Ser Gly (GSSG, SEQ ID NO: 48)
Gly Gly Gly Gly Ser (GGGGS, SEQ ID NO: 49)
Gly Gly Gly Ser Gly (GGGSG, SEQ ID NO: 33)
Gly Gly Ser Gly Gly (GGSGG, SEQ ID NO: 30)
Gly Ser Gly Gly Gly (GSGGG, SEQ ID NO: 32)
Gly Ser Gly Gly Ser (GSGGS, SEQ ID NO: 27)
Ser Gly Gly Gly Gly (SGGGG, SEQ ID NO: 51)
Gly Ser Ser Gly Gly (GSSGG, SEQ ID NO: 52)
Gly Ser Gly Ser Gly (GSGSG, SEQ ID NO: 31)
Ser Gly Gly Ser Gly (SGGSG, SEQ ID NO: 53)
Gly Ser Ser Ser Gly (GSSSG, SEQ ID NO: 34)
Gly Gly Gly Gly Gly Ser (GGGGGS, SEQ ID NO: 50)
Ser Gly Gly Gly Gly Gly (SGGGGG, SEQ ID NO: 54)
Gly Gly Gly Gly Gly Gly Ser (GGGGGGS, SEQ ID NO: 55)
Ser Gly Gly Gly Gly Gly Gly (SGGGGGG, SEQ ID NO: 56)
(Gly Gly Gly Gly Ser (GGGGS, SEQ ID NO: 49))n
(Ser Gly Gly Gly Gly (SGGGG, SEQ ID NO: 51))n In the present specification, the "association" can refer to, for example, a state where two or more polypeptide regions interact with each other. In general, a hydrophobic bond, a hydrogen bond, an ionic bond, or the like is formed between the intended polypeptide regions to form an associate. As one example of common association, an antibody typified by a natural antibody is known to retain a paired structure of a heavy chain variable region (VH) and a light chain variable region (VL) through a noncovalent bond or the like therebetween.

In some embodiments of the present invention, the inhibiting domain of the carrying moiety associates with the antigen binding domain. The inhibiting domain may constitute a portion of the carrying moiety or may constitute the whole of the carrying moiety. From another viewpoint, the inhibiting domain can also be defined as a moiety associating with the antigen binding domain, in the carrying moiety.

In a more specific embodiment, the antigen binding domain and the inhibiting domain which is VL, VH or VHH form association as found between antibody VH and antibody VL, or association between antibody VH or antibody VH, or between antibody VL and antibody VL. In a further specific embodiment, the antigen binding domain and the inhibiting domain which is VL, VH or VHH form association as found between antibody VH and antibody VL, and in a state of the association thus formed, the inhibiting domain conformationally inhibits the binding of the antigen binding domain to the antigen or conformationally changes the antigen binding site of the antigen binding domain so that the antigen binding activity of the antigen binding domain is inhibited by the VL, the VH or the VHH. In an embodiment using VHH as the antigen binding domain, it is considered that the binding of the VHH to the antigen is conformationally inhibited by the inhibiting domain when CDR3, a main antigen binding site of the VHH, or its neighboring site exists at the interface of association with the inhibiting domain.

The association of the antigen binding domain with the inhibiting domain may be canceled, for example, by cleaving the cleavage site. The cancelation of the association can be used interchangeably with, for example, the cancelation of the state where two or more polypeptide regions interact with each other. The interaction between the two or more polypeptide regions may be wholly canceled, or the interaction between the two or more polypeptide regions may be partially canceled.

In the present specification, the "interface" usually refers to a face at which two regions associate or interact with each other. Amino acid residues forming the interface are usually one or more amino acid residues contained in each polypeptide region subjected to the association and more preferably refer to amino acid residues that approach each other upon association and participate in interaction. Specifically, the interaction includes a noncovalent bond such as a hydrogen bond, electrostatic interaction, or salt bridge formation between the amino acid residues approaching each other upon association.

In the present specification, the "amino acid residues forming the interface" specifically refers to amino acid residues contained in polypeptide regions constituting the interface. As one example, the polypeptide regions constituting the interface refer to polypeptide regions responsible for intramolecular or intermolecular selective binding in antibodies, ligands, antagonists, receptors, substrates, etc. Specific examples of such polypeptide regions in antibodies can include a heavy chain variable region and a light chain variable region. In some embodiments of the present invention, examples of such polypeptide regions can include an antigen binding domain and an inhibiting domain.

Examples of the amino acid residues forming the interface include, but are not limited to, amino acid residues approaching each other upon association. The amino acid residues approaching each other upon association can be found, for example, by analyzing the conformations of polypeptides and examining the amino acid sequences of polypeptide regions forming the interface upon association of the polypeptides.

In some embodiments of the present invention, an amino acid residue involved in association in the antigen binding domain, or an amino acid residue involved in association in the inhibiting domain can be altered in order to promote the association of the antigen binding domain with the inhibiting domain. In a further specific embodiment, an amino acid residue forming the interface with the inhibiting domain, in the antigen binding domain, or an amino acid residue forming the interface with the antigen binding domain, in the inhibiting domain can be altered. In a preferred embodiment, the amino acid residue forming the interface can be altered by a method of introducing a mutation to the interface amino acid residue such that two or more amino acid residues forming the interface have different charges. The alteration of the amino acid residue to result in different charges includes the alteration of a positively charged amino acid residue to a negatively charged amino acid residue or an uncharged amino acid residue, the alteration of a negatively charged amino acid residue to a positively charged amino acid residue or an uncharged amino acid residue, and the alteration of an uncharged amino acid residue to a positively or negatively charged amino acid residue. Such an amino acid alteration is performed for the purpose of promoting the association and is not limited by the position of the amino acid alteration or the type of the amino acid as long as the purpose of promoting the association can be achieved. Examples of the alteration include, but are not limited to, substitution.

In some embodiments of the present invention, VHH serving as the antigen binding domain associates with VL serving as the inhibiting domain. The amino acid residue involved in association with VL, in VHH can refer to, for example, an amino acid residue forming the interface between the VHH and the VL. Examples of the amino acid residue involved in association with VL, in VHH include, but are not limited to, amino acid residues at positions 37, 44, 45, and 47 (J. Mol. Biol. (2005) 350, 112-125). The activity of the VHH is inhibited by promoting the association between the VHH and the VL. Likewise, the amino acid residue involved in association with VHH, in VL can refer to, for example, an amino acid residue forming the interface between the VHH and the VL.

An amino acid residue involved in association with VL, in VHH can be altered in order to promote the association between the VHH and the VL. Examples of such an amino acid substitution include, but are not limited to, F37V, Y37V, E44G, Q44G, R45L, H45L, G47W, F47W, L47W, T47W, or/and S47W. Instead of altering each residue in VHH, VHH originally having an amino acid residue 37V, 44G, 45L, or/and 47W may be used.

Instead of the VHH amino acid, an amino acid residue involved in association with VHH, in VL may be altered, and amino acid alterations may also be introduced to both VHH and VL, as long as the purpose of promoting the association between the VHH and the VL can be achieved.

In some alternative embodiments of the present invention, the antigen binding domain and the inhibiting domain can be associated with each other by using VHH as the antigen binding domain and using VH or VHH as the inhibiting domain. An amino acid residue involved in association with VH or VHH serving as the inhibiting domain, in VHH serving as the antigen binding domain can be identified and altered in order to promote the association of the antigen binding domain VHH with the inhibiting domain VH or VHH. Also, an amino acid residue involved in association with VHH serving as the antigen binding domain, in VH or VHH serving as the inhibiting domain, can be identified and altered.

In the case of using an antigen binding domain other than VHH, an amino acid residue involved in association, in the antigen binding domain or the inhibiting domain can also be identified and altered similarly to above.

In some embodiments of the present invention, the carrying moiety and the antigen binding domain are fused. The order of the carrying moiety and the antigen binding domain in the fusion protein is not limited. The N terminus of the carrying moiety can be linked to the C terminus of the antigen binding domain with or without a linker, alternatively, the C terminus of the carrying moiety can be linked to the N terminus of the antigen binding domain with or without a linker.

In some embodiments of the present invention, the carrying moiety and the antigen binding domain are fused via a linker. In a more specific embodiment, the carrying moiety and the antigen binding domain are fused via a linker containing a cleavage site. In an alternative specific embodiment, the carrying moiety and the antigen binding domain are fused via a linker, and the fusion protein thus formed contains a cleavage site.

In another embodiment of the present invention, the carrying moiety and the antigen binding domain are fused without a linker. In a more specific embodiment, an amino bond is formed between the N-terminal amino acid of the carrying moiety and the C-terminal amino acid of the antigen binding domain to form a fusion protein. The formed fusion protein contains a cleavage site. In a particular embodiment, one to several N-terminal amino acids of the carrying moiety or/and one to several C-terminal amino acids of the antigen binding domain are altered, and the N terminus of the carrying moiety and the C terminus of the antigen binding domain are fused to form a cleavage site near the fusion position. More specifically, the cleavage site can be formed, for example, by converting four C-terminal amino acids of the antigen binding domain to a LSGR sequence and converting four N-terminal amino acids of the carrying moiety to a SDNH sequence.

In some embodiments of the present invention, the cleavage site of the polypeptide comprising a carrying moiety and an antigen binding domain comprises a protease cleavage sequence. The protease cleavage sequence may be placed at any position in the polypeptide as long as the antigen binding domain is released by protease cleavage and does not lose its antigen binding activity after the release. The cleavage sequence can be located, for example, between the N terminus of the carrying moiety and the C terminus of the antigen binding domain, the C terminus of the carrying moiety and the N terminus of the antigen binding domain, within the sequence of the antigen binding domain, or within the sequence of the carrying moiety.

In some embodiments of the present invention, the carrying moiety comprises an antibody constant region, and the N terminus of the antibody constant region and the C terminus of the antigen binding domain are fused via a linker or without a linker.

In a particular embodiment, the protease cleavage sequence is located within the antibody constant region contained in the carrying moiety. In this case, the protease cleavage sequence can be located within the antibody constant region such that the antigen binding domain is released by protease cleavage. In a specific embodiment, the protease cleavage sequence is located within an antibody heavy chain constant region contained in the carrying moiety, and more specifically located on the antigen binding domain side with respect to amino acid position 140 (EU numbering) in the antibody heavy chain constant region, preferably on the antigen binding domain side with respect to amino acid position 122 (EU numbering) in the antibody heavy chain constant region. In an alternative specific embodiment, the protease cleavage sequence is located within an antibody light chain constant region contained in the carrying moiety, and more specifically located on the antigen binding domain side with respect to amino acid position 130 (EU numbering) (Kabat numbering position 130) in the antibody light chain constant region, preferably on the antigen binding domain side with respect to amino acid position 113 (EU numbering) (Kabat numbering position 113) in the antibody light chain constant region.

In some embodiments of the present invention, the antigen binding domain is a single-domain antibody, and the C terminus of the single-domain antibody and the N terminus of the carrying moiety are fused via a linker or without a linker.

In a particular embodiment, the protease cleavage sequence is located within the antigen binding domain. In a more specific embodiment, the antigen binding domain is a single-domain antibody, and the single-domain antibody is a single-domain antibody prepared from VH, or VHH, and the protease cleavage sequence is located on the carrying moiety side with respect to amino acid position 35b (Kabat numbering) of the single-domain antibody, preferably on the carrying moiety side with respect to amino acid position 95 (Kabat numbering) of the single-domain antibody, more preferably on the carrying moiety side with respect to amino acid position 109 (Kabat numbering) of the single-domain antibody. In an alternative specific embodiment, the antigen binding domain is a single-domain antibody, and the single-domain antibody is a single-domain antibody prepared from VL, and the protease cleavage sequence is located on the carrying moiety side with respect to amino acid position 32 (Kabat numbering) of the single-domain antibody, preferably on the carrying moiety side with respect to amino acid position 91 (Kabat numbering) of the single-domain antibody, more preferably on the carrying moiety side with respect to amino acid position 104 (Kabat numbering) of the single-domain antibody.

In some embodiments of the present invention, the carrying moiety comprises an antibody constant region, the antigen binding domain is a single-domain antibody, and the antibody constant region and the single-domain antibody are fused via a linker or without a linker. In a more specific embodiment, the N terminus of the antibody constant region and the C terminus of the single-domain antibody are fused via a linker or without a linker. In an alternative specific embodiment, the C terminus of the antibody constant region and the N terminus of the single-domain antibody are fused via a linker or without a linker.

In a particular embodiment, the protease cleavage sequence is located within the antibody constant region contained in the carrying moiety. In a more specific embodiment, the protease cleavage sequence is located on the antigen binding domain side with respect to amino acid position 140 (EU numbering) in an antibody heavy chain constant region, preferably on the antigen binding domain side with respect to amino acid position 122 (EU numbering) in an antibody heavy chain constant region. In an alternative specific embodiment, the protease cleavage sequence is located on the antigen binding domain side with respect to amino acid position 130 (EU numbering) (Kabat numbering position 130) in an antibody light chain constant region, preferably on the antigen binding domain side with respect to amino acid position 113 (EU numbering) (Kabat numbering position 113) in an antibody light chain constant region.

In a particular embodiment, the protease cleavage sequence is located within the antigen binding domain. In a more specific embodiment, the antigen binding domain is a single-domain antibody, and the single-domain antibody is a single-domain antibody prepared from VH, or VHH, and the protease cleavage sequence is located on the antibody constant region side with respect to amino acid position 35b (Kabat numbering) of the single-domain antibody, preferably on the antibody constant region side with respect to amino acid position 95 (Kabat numbering) of the single-domain antibody, more preferably on the antibody constant region side with respect to amino acid position 109 (Kabat numbering) of the single-domain antibody. In an alternative specific embodiment, the antigen binding domain is a single-domain antibody, and the single-domain antibody is a single-domain antibody prepared from VL, and the protease cleavage sequence is located on the antibody constant region side with respect to amino acid position 32 (Kabat numbering) of the single-domain antibody, preferably on the antibody constant region side with respect to amino acid position 91 (Kabat numbering) of the single-domain antibody, more preferably on the antibody constant region side with respect to amino acid position 104 (Kabat numbering) of the single-domain antibody.

In a particular embodiment, the protease cleavage sequence is located near the boundary between the antigen binding domain and the carrying moiety. The phrase "near the boundary between the antigen binding domain and the carrying moiety" refers to a moiety that resides upstream or downstream of the linking site between the antigen binding domain and the carrying moiety and does not largely influence the secondary structure of the antigen binding domain.

In a more specific embodiment, the antigen binding domain is linked to the antibody constant region contained in the carrying moiety, and the protease cleavage sequence is located near the boundary between the antigen binding domain and the antibody constant region. The phrase "near the boundary between the antigen binding domain and the antibody constant region" can refer to near the boundary between the antigen binding domain and an antibody heavy chain constant region, or near the boundary between the antigen binding domain and an antibody light chain constant region. When the antigen binding domain is a single-domain antibody, and the single-domain antibody is a single-domain antibody prepared from VH, or VHH and is connected to an antibody heavy chain constant region, the phrase "near the boundary between the antigen binding domain and the antibody constant region" can refer to between amino acid position 101 (Kabat numbering) of the single-domain antibody and amino acid position 140 (EU numbering) of the antibody heavy chain constant region and can preferably refer to between amino acid position 109 (Kabat numbering) of the single-domain antibody and amino acid position 122 (EU numbering) of the antibody heavy chain constant region. When the antigen binding domain is a single-domain antibody, and the single-domain antibody is a single-domain antibody prepared from VH, or VHH and is connected to an antibody light chain constant region, the phrase "near the boundary between the antigen binding domain and the antibody light chain constant region" can refer to between amino acid position 101 (Kabat numbering) of the single-domain antibody and amino acid position 130 (EU numbering) (Kabat numbering position 130) of the antibody light chain constant region and can preferably refer to between amino acid position 109 (Kabat numbering) of the single-domain antibody and amino acid position 113 (EU numbering) (Kabat numbering position 113) of the antibody light chain constant region. When the antigen binding domain is a single-domain antibody, and the single-domain antibody is a single-domain antibody prepared from VL, the phrase "near the boundary between the antigen binding domain and the antibody constant region" refers to between amino acid position 96 (Kabat numbering) of the single-domain antibody and the prescribed position of the antibody constant region, preferably between amino acid position 104 (Kabat numbering) of the single-domain antibody and the prescribed position of the antibody constant region.

In some embodiments of the present invention, the polypeptide is an IgG antibody-like molecule. Examples of such embodiments include, but are not limited to: an embodiment in which the carrying moiety comprises an IgG antibody constant region, an antigen binding domain takes the place of VH of an IgG antibody or a modified IgG antibody, and the antigen binding activity is inhibited by VL or VH; an embodiment in which the carrying moiety comprises an IgG antibody constant region, an antigen binding domain takes the place of VL of an IgG antibody or a modified IgG antibody, and the antigen binding activity is inhibited by VH or VL; and an embodiment in which the carrying moiety comprises an IgG antibody constant region, an antigen binding domain takes the place of one of VH and VL of an IgG antibody or a modified IgG antibody, and an additional antigen binding domain that inhibits the antigen binding activity of the antigen binding domain takes the place of the other domain of the IgG antibody or a modified IgG antibody.

The term "IgG antibody-like molecule" and "modified IgG antibody" used in the present specification is used to define a molecule having moieties substantially similar in structure to constant domains or constant regions as in an IgG antibody, and moieties substantially similar in structure to variable domains or variable regions as in the IgG antibody, and having conformation substantially similar to that of the IgG antibody. However, in the present specification, the "IgG antibody-like molecule" and "modified IgG antibody" may or may not exert antigen binding activity while retaining the structures similar to those of the IgG antibody. The terms "IgG antibody-like molecule", "IgG-antibody like molecule" and "IgG-antibody-like molecule" are used interchangeably with each other herein.

In some embodiments of the present invention, the following types of antibodies are exemplified as the "modified IgG antibody";
 (i) a "modified IgG antibody" in which a H chain variable domain or a H chain variable region as in the IgG antibody is substituted with a L chain variable domain or a L chain variable region,
 (ii) a "modified IgG antibody" in which a L chain variable domain or a L chain variable region as in the IgG antibody is substituted with a H chain variable domain or a H chain variable region,
 (iii) a "modified IgG antibody" in which a H chain constant domain or a H chain constant region as in the IgG antibody is substituted with a L chain constant domain or a L chain constant region,
 (iv) a "modified IgG antibody" in which a L chain constant domain or a L chain constant region as in the IgG antibody is substituted with a H chain constant domain or a H chain constant region,
 (v) a "modified IgG antibody" having the features defined in the above (i) and (ii),
 (vi) a "modified IgG antibody" having the features defined in the above (i) and (iii),
 (vii) a "modified IgG antibody" having the features defined in the above (i) and (iv),
 (viii) a "modified IgG antibody" having the features defined in the above (ii) and (iii),
 (ix) a "modified IgG antibody" having the features defined in the above (ii) and (iv),
 (x) a "modified IgG antibody" having the features defined in the above (iii) and (iv)
 (xi) a "modified IgG antibody" having the features defined in the above (i), (ii) and (iii),
 (xii) a "modified IgG antibody" having the features defined in the above (i), (ii) and (iv),
 (xiii) a "modified IgG antibody" having the features defined in the above (i), (iii) and (iv), and
 (xiv) a "modified IgG antibody" having the features defined in the above (ii), (iii) and (iv).

The polypeptide may comprise one or more antigen binding domains. One or more inhibiting domains may inhibit the antigen binding activity of a plurality of antigen binding domains. A plurality of antigen binding domains may each be associated with the inhibiting domain. A plurality of antigen binding domains may each be fused with the carrying moiety. A plurality of antigen binding domains may each be capable of released from the polypeptide. The cleavage site(s) for releasing a plurality of antigen binding domains may be a plurality of cleavage sites corresponding to the number of antigen binding domains.

Figure 7:
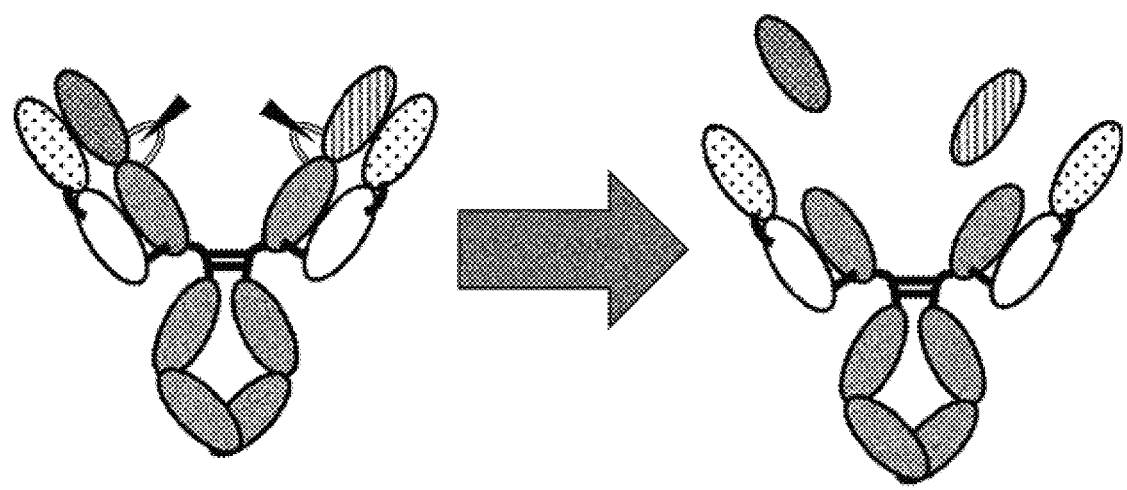

When the polypeptide is an IgG antibody-like molecule, antigen binding domains may be respectively established at moieties corresponding to two variable regions of the IgG antibody, as shown in FIG. 7. Such an embodiment should be understandable by those skilled in the art with reference to the present invention. The antigen binding domains incorporated in both arms may have the same antigen binding specificity or may differ in antigen binding specificity. Such an embodiment should be understandable by those skilled in the art with reference to the present invention. It is obvious that these embodiments are included in the scope of the present invention.

In some embodiments of the present invention, the antigen binding domain is further linked to a second antigen binding domain. Examples of the second antigen binding domain include, but are not limited to, single-domain antibodies, antibody fragments, antagonists, a module called A domain of approximately 35 amino acids contained in an in vivo cell membrane protein avimer (International Publication Nos. WO2004/044011 and WO2005/040229), adnectin containing a 10Fn3 domain serving as a protein binding domain derived from a glycoprotein fibronectin expressed on cell membranes (International Publication No. WO2002/032925), Affibody containing an IgG binding domain scaffold constituting a three-helix bundle composed of 58 amino acids of protein A (International Publication No. WO1995/001937), DARPins (designed ankyrin repeat proteins) which are molecular surface-exposed regions of ankyrin repeats (AR) each having a 33-amino acid residue structure folded into a subunit of a turn, two antiparallel helices, and a loop (International Publication No. WO2002/020565), anticalin having four loop regions connecting eight antiparallel strands bent toward the central axis in one end of a barrel structure highly conserved in lipocalin molecules such as neutrophil gelatinase-associated lipocalin (NGAL) (International Publication No. WO2003/029462), and a depressed region in the internal parallel sheet structure of a horseshoe-shaped fold composed of repeated leucine-rich-repeat (LRR) modules of an immunoglobulin structure-free variable lymphocyte receptor (VLR) as seen in the acquired immune systems of jawless vertebrates such as lamprey or hagfish (International Publication No. WO2008/016854). In a preferred embodiment, the second antigen binding domain has antigen binding specificity different from that of the antigen binding domain. In a preferred embodiment, the molecular weight of the antigen binding domain and the second antigen binding domain linked is 120 kDa, 100 kDa, 80 kDa, 60 kDa or smaller.

In some more specific embodiments, the antigen binding domain and the second antigen binding domain are single-domain antibodies differing in antigen binding specificity, the antigen binding domain and the second antigen binding domain linked are capable of being released from the polypeptide, and the antigen binding domain and the second antigen binding domain form a bispecific antigen binding molecule after release. Examples of such a bispecific antigen binding molecule include, but are not limited to, a bispecific antigen binding molecule having an antigen binding domain specifically binding to the target cell surface antigen and a second antigen binding domain specifically binding to an immunocyte surface antigen, a bispecific antigen binding molecule having an antigen binding domain and a second antigen binding domain binding to different subunits of the same antigen, and a bispecific antigen binding molecule having an antigen binding domain and a second antigen binding domain binding to different epitopes in the same antigen. Such a bispecific antigen binding molecule can recruit immunocytes to the vicinity of target cells and is thus considered useful in the treatment of a disease caused by the target cells.

The antigen binding activity of the second antigen binding domain may or may not be inhibited by the carrying moiety. The second antigen binding domain may or may not be associated with a partial structure of the carrying moiety. Particularly, when the antigen binding domain and the second antigen binding domain differ in antigen binding specificity, the antigen binding domain in an unreleased state cannot exert antigen binding activity, as shown in, for example, FIG. 8, even if the antigen binding activity of the second antigen binding domain is not inhibited and even if the second antigen binding domain is not associated with a partial structure of the carrying moiety. This bispecific antigen binding molecule comprising the antigen binding domain linked to the second antigen binding domain cannot exert a function of bispecifically binding to two types of antigens.

Figure 8:
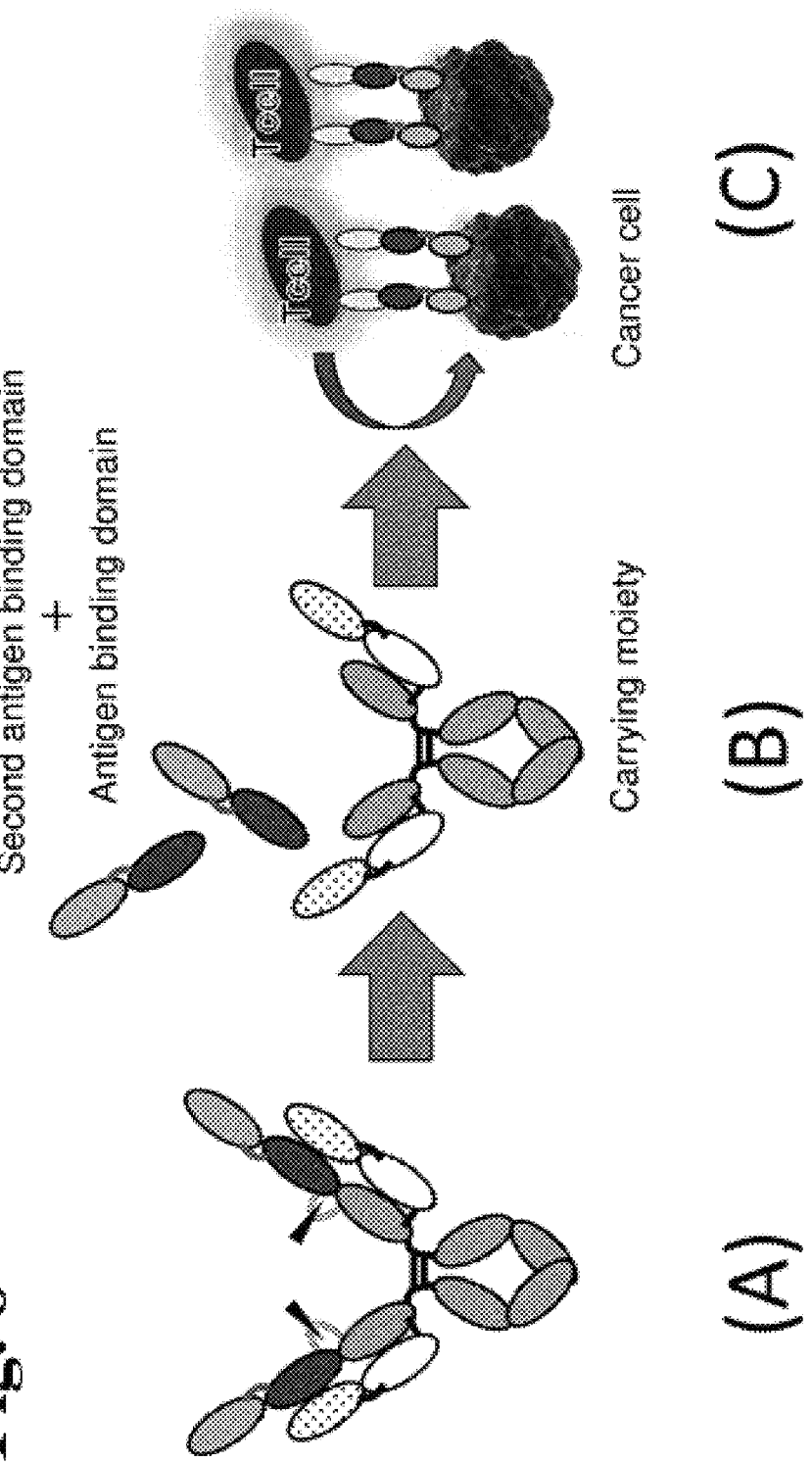

FIG. 8 shows one exemplary form in which the antigen binding domain is further linked to the second antigen binding domain.

In the present specification, the term "specificity" refers to a property by which one of specifically binding molecules does not substantially bind to a molecule other than its one or more binding partner molecules. This term is also used when the antigen binding domain has specificity for an epitope contained in a particular antigen. The term is also used when the antigen binding domain has specificity for a particular epitope among a plurality of epitopes contained in an antigen. In this context, the term "not substantially bind" is determined according to the method described in the section about binding activity and means that the binding activity of a specific binding molecule for a molecule other than the binding partner(s) is 80% or less, usually 50% or less, preferably 30% or less, particularly preferably 15% or less, of its binding activity for the binding partner molecule(s).

The molecular weight of the polypeptide of the present invention is not limited. For example, the molecular weight of the polypeptide of the present invention is not more than 150 kDa. Preferably, the molecular weight of the polypeptide of the present invention is 145 kDa or less, 140 kDa or less, 135 kDa or less, 130 kDa or less, 120 kDa or less, 100 kDa or less, 80 kDa or less, 60 kDa or less, 50 kDa or less, 40 kDa or less, 30 kDa or less, or 20 kDa or less. The molecular weight of the antigen binding domain comprised in the polypeptide of the present invention is, for example, 100 kDa or less, 80 kDa or less, 60 kDa or less, 50 kDa or less, 40 kDa or less, 30 kDa or less, 20 kDa or less, or 15 kDa or less.

The type of the polypeptide of the present invention is not particularly limited. For example, the polypeptide of the present invention can be any type of antibody, including but not limited to a human antibody, a humanized antibody, a monoclonal antibody, a naked antibody, a native antibody, and a single-domain antibody. Specifically, small type of antibody may be preferable. For example, the polypeptide of the present invention may be, but not limited to, Fab, scFv, VHH, VL, VH or single domain antibody.

The present invention also relates to a pharmaceutical composition (drug) comprising the polypeptide of the present invention and a pharmaceutically acceptable carrier.

The "treatment" (and its grammatically derived words, for example, "treat" and "treating") used in the present specification means clinical intervention that intends to alter the natural course of an individual to be treated and can be carried out both for prevention and during the course of a clinical pathological condition. The desirable effect of the treatment includes, but is not limited to, the prevention of the development or recurrence of a disease, the alleviation of symptoms, the attenuation of any direct or indirect pathological influence of the disease, the prevention of metastasis, reduction in the rate of progression of the disease, recovery from or alleviation of a disease condition, and ameliorated or improved prognosis. In some embodiments, the polypeptide of the present invention is used for delaying the onset of a disease or delaying the progression of the disease.

In the present invention, the pharmaceutical composition usually refers to a drug for the treatment or prevention of a disease or for examination or diagnosis. In the present invention, the term "pharmaceutical composition comprising the polypeptide" may be used interchangeably with a "method for treating a disease, comprising administering the polypeptide to a subject to be treated" and may be used interchangeably with "use of the polypeptide for the production of a drug for the treatment of a disease". Also, the term "pharmaceutical composition comprising the polypeptide" may be used interchangeably with "use of the polypeptide for treating a disease".

The pharmaceutical composition of the present invention can be formulated by use of a method known to those skilled in the art. For example, the pharmaceutical composition can be parenterally used in an injection form of a sterile solution or suspension with water or any of other pharmaceutically acceptable liquids. The pharmaceutical composition can be formulated, for example, by appropriately combining the polypeptide with a pharmacologically acceptable carrier or medium, specifically, sterile water or physiological saline, a plant oil, an emulsifier, a suspending agent, a surfactant, a stabilizer, a flavoring agent, an excipient, a vehicle, an antiseptic, a binder, etc. and mixing them into a unit dosage form required for generally accepted pharmaceutical practice. The amount of the active ingredient in these formulations is set so as to give an appropriate volume in a prescribed range.

A sterile composition for injection can be formulated according to usual pharmaceutical practice using a vehicle such as injectable distilled water. Examples of the injectable aqueous solution include isotonic solutions containing physiological saline, glucose, or other adjuvants (e.g., D-sorbitol, D-mannose, D-mannitol, and sodium chloride). The aqueous solution can be used in combination with an appropriate solubilizer, for example, an alcohol (ethanol, etc.), a polyalcohol (propylene glycol, polyethylene glycol, etc.), or a nonionic surfactant (Polysorbate 80(TM), HCO-50, etc.).

Examples of the oil solution include sesame oil and soybean oil. The oil solution can also be used in combination with benzyl benzoate and/or benzyl alcohol as a solubilizer. The oil solution can be supplemented with a buffer (e.g., a phosphate buffer solution and a sodium acetate buffer solution), a soothing agent (e.g., procaine hydrochloride), a stabilizer (e.g., benzyl alcohol and phenol), and an antioxidant. The prepared injection solution is usually filled into an appropriate ampule.

The pharmaceutical composition of the present invention is preferably administered through a parenteral route. For example, a composition having an injection, intraarticular, transnasal, transpulmonary, or percutaneous dosage form is administered. The pharmaceutical composition can be administered systemically or locally by, for example, intravenous injection, intramuscular injection, intraperitoneal injection, or subcutaneous injection.

The administration method can be appropriately selected according to the age and symptoms of a patient. The dose of the pharmaceutical composition containing the polypeptide can be set to the range of, for example, 0.0001 mg to 1000 mg per kg body weight per dose. Alternatively, the dose of the pharmaceutical composition containing the polypeptide can be set to a dose of, for example, 0.001 to 100000 mg per patient. However, the present invention is not necessarily limited by these numerical values. Although the dose and the administration method vary depending on the body weight, age, symptoms, etc. of a patient, those skilled in the art can set an appropriate dose and administration method in consideration of these conditions. Subjects to be administered (applied) with the polypeptide of the present invention include, which can be virtually any animal, for example, a human, rabbit, monkey, mouse, rat, pig, dog, etc.

The pharmaceutical composition of the present invention is useful for delivering a drug to a cartilage tissue and retaining the drug in the tissue for a long time. For example, the pharmaceutical composition of the present invention is useful for treating and/or preventing an Aggrecan mediated disease or disorder. The pharmaceutical composition of the present invention is also useful for treating and/or preventing osteoarthritis (OA), cartilage degradation, and/or cartilage matrix degradation. The pharmaceutical composition of the present invention is administered to a subject at an amount effective for treating and/or preventing said disease or disorder. Effective amount can be determined by routine experiments well known by a person skilled in the art.

The present invention also relates to a method for producing a polypeptide comprising a carrying moiety having an inhibiting domain, and an antigen binding domain.

One method for producing the polypeptide of the present invention is a method comprising: obtaining an antigen binding domain having antigen binding activity; linking the antigen binding domain to a carrying moiety such that the antigen binding activity of the antigen binding domain is inhibited by an inhibiting domain, to form a polypeptide precursor; and further inserting a cleavage site into the polypeptide precursor or altering a portion of the polypeptide precursor to a cleavage site. The method for introducing the cleavage site can be any of the insertion of the cleavage site and the alteration of a portion of the polypeptide precursor as long as the cleavage site can be introduced into the polypeptide precursor. Alternatively, an alteration site may be introduced into the polypeptide precursor by the combination of both the approaches. Such an embodiment should be obvious to those skilled in the art with reference to the present specification and is included in the scope of the present invention.

Another method for producing the polypeptide of the present invention is a method comprising: obtaining an antigen binding domain having antigen binding activity; and linking the antigen binding domain to a carrying moiety via a cleavage site such that the antigen binding activity of the antigen binding domain is inhibited by an inhibiting domain, to form a polypeptide. When the antigen binding domain is linked to the carrying moiety via a cleavage site, the cleavage site may be sandwiched between the antigen binding domain and the carrying moiety, or a portion of the antigen binding domain or/and a portion of the carrying moiety may be altered and used as a portion of the cleavage site.

The method for producing the polypeptide will be described below. In one embodiment of the present invention, the antigen binding domain is preferably a VL having antigen binding activity by itself. Further, in one embodiment of the present invention, an antigen is preferably a component in a cartilage tissue, more preferably, a component of extracellular matrix such as aggrecan.

In one embodiment of the present invention, the method for producing a polypeptide comprising a carrying moiety having an inhibiting domain, and an antigen binding domain is a production method comprising the following steps:
 (a) obtaining an antigen binding domain binding to a target antigen;
 (b) linking the antigen binding domain obtained in the step (a) to a carrying moiety such that the antigen binding activity of the antigen binding domain is inhibited by an inhibiting domain of the carrying moiety, to form a polypeptide precursor; and
 (c) introducing a protease cleavage sequence into the polypeptide precursor.

In one embodiment of the present invention, the method for producing a polypeptide comprising a carrying moiety having an inhibiting domain, and an antigen binding domain is a production method comprising the following steps:
 (a) obtaining an antigen binding domain binding to a target antigen;
 (b) linking the antigen binding domain obtained in the step (a) to a carrying moiety such that the antigen binding activity of the antigen binding domain is inhibited by an inhibiting domain of the carrying moiety, to form a polypeptide precursor; and
 (c) introducing a protease cleavage sequence to near the boundary between the antigen binding domain and the carrying moiety.

In one embodiment of the present invention, the method for producing a polypeptide comprising a carrying moiety having an inhibiting domain, and an antigen binding domain is a production method comprising the following steps:
 (a) obtaining an antigen binding domain binding to a target antigen; and
 (b) linking the antigen binding domain obtained in the step (a) to the carrying moiety via a protease cleavage sequence such that the antigen binding activity of the antigen binding domain is inhibited by an inhibiting domain of the carrying moiety, to form a polypeptide.

In a particular embodiment, the method for producing a polypeptide comprising a carrying moiety having an inhibiting domain, and an antigen binding domain is the production method further comprising the following step:
 (d) confirming that the binding activity of the antigen binding domain incorporated in the polypeptide or the polypeptide precursor against the target antigen is weakened or lost.

In the present invention, the phrase "binding activity is weakened" means that the binding activity against the target antigen is decreased as compared with that before the linking, and the degree of this decrease is not limited.

In a particular embodiment, the method for producing a polypeptide comprising a carrying moiety having an inhibiting domain, and an antigen binding domain is the production method further comprising the following step:
 (e) releasing the antigen binding domain by the protease cleavage of the protease cleavage sequence and confirming that the released antigen binding domain binds to the antigen.

In one embodiment of the present invention, the method for producing a polypeptide which is an IgG antibody-like molecule comprising a carrying moiety having an inhibiting domain, and an antigen binding domain is a production method comprising the following steps:

(a) obtaining an antigen binding domain binding to a target antigen;

(b) associating the antigen binding domain obtained in the step (a) as a substitute for VH of an IgG antibody or a modified IgG antibody with VL or VH, or associating the antigen binding domain as a substitute for VL of an IgG antibody or a modified IgG antibody with VH or VL such that the antigen binding activity of the antigen binding domain is inhibited, to form an IgG antibody-like molecule precursor harboring the antigen binding domain; and (c) introducing a protease cleavage sequence into the IgG antibody-like molecule precursor harboring the antigen binding domain.

In one embodiment of the present invention, the method for producing a polypeptide which is an IgG antibody-like molecule comprising a carrying moiety having an inhibiting domain, and an antigen binding domain is a production method comprising the following steps:

(a) obtaining an antigen binding domain binding to a target antigen;

(b) associating the antigen binding domain obtained in the step (a) as a substitute for VH of an IgG antibody or a modified IgG antibody with VL or VH, or associating the antigen binding domain as a substitute for VL of an IgG antibody or a modified IgG antibody with VH or VL such that the antigen binding activity of the antigen binding domain is inhibited, to form an IgG antibody-like molecule precursor harboring the antigen binding domain; and (c) introducing a protease cleavage sequence to near the boundary between the antigen binding domain and an antibody constant region in the IgG antibody-like molecule precursor.

In one embodiment of the present invention, the method for producing a polypeptide which is an IgG antibody-like molecule comprising a carrying moiety having an inhibiting domain, and an antigen binding domain is a production method comprising the following steps:

(a) obtaining an antigen binding domain binding to a target antigen; and (b) linking the antigen binding domain obtained in the step (a) as a substitute for IgG antibody VH or VL to an IgG antibody heavy chain constant region or light chain constant region via a protease cleavage sequence such that the antigen binding activity of the antigen binding domain is inhibited, to form an IgG antibody-like molecule harboring the antigen binding domain.

In a particular embodiment, the method for producing a polypeptide which is an IgG antibody-like molecule comprising a carrying moiety having an inhibiting domain, and an antigen binding domain is the production method further comprising the following step:

(d) confirming that the binding activity of the antigen binding domain harbored in the IgG antibody-like molecule or the IgG antibody-like molecule precursor against the target antigen is weakened or lost.

In the present invention, the phrase "binding activity is weakened" means that the binding activity against the target antigen is decreased as compared with that before the association or the linking, and the degree of this decrease is not limited.

In a particular embodiment, the method for producing a polypeptide which is an IgG antibody-like molecule comprising a carrying moiety having an inhibiting domain, and an antigen binding domain is the production method further comprising the following step:
  (e) releasing the antigen binding domain by the protease cleavage of the protease cleavage sequence and confirming that the released antigen binding domain binds to the target antigen.

In the case of using VH, VL or VHH as the inhibiting domain, the method for inhibiting the antigen binding activity of the antigen binding domain by the inhibiting domain of the carrying moiety includes a method of associating the antigen binding domain with VH, VL or VHH. The VH, the VL or the VHH that inhibits the antigen binding activity of the provided antigen binding domain can be screened for by associating known VH, VL or VHH with the antigen binding domain and comparing the antigen binding activity of the antigen binding domain between before and after the association.

In another method for inhibiting the antigen binding activity of the antigen binding domain by particular VH, VL or VHH, an amino acid residue involved in association with VH, VL or VHH, in the antigen binding domain can be substituted to promote the association, or an antigen binding domain/inhibiting domain pair having the desired level of difference in antigen binding activity between before and after the association can also be provided by using an antigen binding domain originally having, as such an amino acid residue, an amino acid that can promote the association.

In one embodiment of the present invention, the method for producing a polypeptide which is an IgG antibody-like molecule comprising a carrying moiety having an inhibiting domain, and an antigen binding domain is a production method comprising the following steps:
  (a) substituting an amino acid residue in an antigen binding domain that involves in association of the antigen binding domain with antibody VH, or substituting an amino acid residue in an antigen binding domain that involves in association of the antigen binding domain with antibody VL to prepare an antigen binding domain variant retaining the binding activity of the antigen binding domain against the target antigen;
  (b) associating the antigen binding domain variant prepared in the step (a) with antibody VH, or associating the antigen binding domain variant with antibody VL such that the antigen binding activity of the antigen binding domain variant is inhibited, to form an IgG antibody-like molecule precursor harboring the antigen binding domain variant; and
  (c) introducing a protease cleavage sequence into the IgG antibody-like molecule precursor harboring the antigen binding domain variant.

In one embodiment of the present invention, the method for producing a polypeptide which is an IgG antibody-like molecule comprising a carrying moiety having an inhibiting domain, and an antigen binding domain is a production method comprising the following steps:
  (a) substituting an amino acid residue in an antigen binding domain that involves in association of the antigen binding domain with antibody VH, or substituting an amino acid residue in an antigen binding domain that involves in association of the antigen binding domain with antibody VL, to prepare an antigen binding domain variant retaining the binding activity of the antigen binding domain against the target antigen;
  (b) associating the antigen binding domain variant prepared in the step (a) with antibody VH or associating the antigen binding domain variant with antibody VL such that the antigen binding activity of the antigen binding domain is inhibited, to form an IgG antibody-like molecule precursor harboring the antigen binding domain variant; and
  (c) introducing a protease cleavage sequence to near the boundary between the antigen binding domain variant and a constant region in the IgG antibody-like molecule precursor.

In one embodiment of the present invention, the method for producing a polypeptide which is an IgG antibody-like molecule comprising a carrying moiety having an inhibiting domain, and an antigen binding domain is a production method comprising the following steps:
  (a) substituting an amino acid residue in an antigen binding domain that involves in association of the antigen binding domain with antibody VH, or substituting an amino acid residue in an antigen binding domain that involves in association of the antigen binding domain with antibody VL, to prepare an antigen binding domain variant retaining the binding activity of the antigen binding domain against the target antigen; and
  (b) linking the antigen binding domain variant prepared in the step (a) to an IgG antibody heavy chain constant region via a protease cleavage sequence, or linking the antigen binding domain variant to an IgG antibody light chain constant region via a protease cleavage sequence such that the antigen binding activity of the antigen binding domain variant is inhibited, to form an IgG antibody-like molecule harboring the antigen binding domain variant.

In a particular embodiment, the method for producing a polypeptide which is an IgG antibody-like molecule comprising a carrying moiety having an inhibiting domain, and an antigen binding domain is the production method further comprising the following step:
  (d) confirming that the binding activity of the antigen binding domain variant harbored in the IgG antibody-like molecule or the IgG antibody-like molecule precursor against the target antigen is weakened or lost.

In the present invention, the phrase "binding activity is weakened" means that the binding activity against the target antigen is decreased as compared with that before the association or the linking, and the degree of this decrease is not limited.

In a particular embodiment, the method for producing a polypeptide which is an IgG antibody-like molecule comprising a carrying moiety having an inhibiting domain, and an antigen binding domain is the production method further comprising the following step:
  (e) releasing the antigen binding domain variant by the protease cleavage of the protease cleavage sequence and confirming that the released antigen binding domain variant binds to the target antigen.

The present invention also relates to a polynucleotide encoding the polypeptide comprising a carrying moiety having an inhibiting domain, and an antigen binding domain.

The polynucleotide according to the present invention is usually carried by (or inserted in) an appropriate vector and transferred to host cells. The vector is not particularly limited as long as the vector can stably retain an inserted nucleic acid. For example, when *E. coli* is used as the host, a pBluescript vector (manufactured by Stratagene Corp.) or the like is preferred as a vector for cloning. Various commercially available vectors can be used. In the case of using the vector for the purpose of producing the polypeptide of the present invention, an expression vector is particularly useful. The expression vector is not particularly limited as long as the vector permits expression of the polypeptide in vitro, in *E. coli*, in cultured cells, or in organism individuals. The expression vector is preferably, for example, a pBEST vector (manufactured by Promega Corp.) for in vitro expression, a pET vector (manufactured by Invitrogen Corp.) for *E. coli*, a pME18S-FL3 vector (GenBank Accession No. AB009864) for cultured cells, and a pME18S vector (Mol Cell Biol. 8: 466-472 (1988)) for organism individuals. The insertion of the DNA of the present invention into the vector can be performed by a routine method, for example, ligase reaction using restriction sites (Current protocols in Molecular Biology edit. Ausubel et al. (1987) Publish. John Wiley & Sons. Section 11.4-11.11).

The host cells are not particularly limited, and various host cells are used according to the purpose. Examples of the cells for expressing the polypeptide can include bacterial cells (e.g., *Streptococcus, Staphylococcus, E. coli, Streptomyces*, and *Bacillus subtilis*), fungal cells (e.g., yeasts and *Aspergillus*), insect cells (e.g., *Drosophila* S2 and *Spodoptera* SF9), animal cells (e.g., CHO, COS, HeLa, C127, 3T3, BHK, HEK293, and Bowes melanoma cells) and plant cells. The transfer of the vector to the host cells may be performed by a method known in the art, for example, a calcium phosphate precipitation method, an electroporation method (Current protocols in Molecular Biology edit. Ausubel et al., (1987) Publish. John Wiley & Sons. Section 9.1-9.9), a Lipofectamine method (manufactured by GIBCO-BRL/Thermo Fisher Scientific Inc.), or a microinjection method.

An appropriate secretory signal can be incorporated into the polypeptide of interest in order to secrete the polypeptide expressed in the host cells to the lumen of the endoplasmic reticulum, periplasmic space, or an extracellular environment. The signal may be endogenous to the polypeptide of interest or may be a foreign signal.

When the polypeptide of the present invention is secreted into a medium, the recovery of the polypeptide in the production method is performed by the recovery of the medium. When the polypeptide of the present invention is produced into cells, the cells are first lysed, followed by the recovery of the polypeptide.

A method known in the art including ammonium sulfate or ethanol precipitation, acid extraction, anion- or cation-exchange chromatography, phosphocellulose chromatography, hydrophobic interaction chromatography, affinity chromatography, hydroxyapatite chromatography, and lectin chromatography can be used for recovering and purifying the polypeptide of the present invention from the recombinant cell cultures.

In some embodiments of the present invention, the antigen binding activity of the antigen binding domain can be inhibited by associating with particular VL, associating with particular VH, or associating with particular VHH.

The present invention also relates to a method for screening for such an antigen binding domain. In one embodiment of the present invention, the antigen binding domain is preferably a VL having antigen binding activity by itself. Further, in one embodiment of the present invention, an antigen is preferably a component in a cartilage tissue, more preferably, a component of extracellular matrix such as aggrecan.

The screening methods of the present invention can be used for screening for a candidate substance of a pharmaceutical. When a screening method of the present invention is conducted on, for example, but not limited to, a component in a cartilage tissue, preferably, a component of extracellular matrix in a cartilage tissue such as aggrecan as a target antigen, an obtained antigen-binding domain can be a candidate for treatment and/or prevention of a disease or disorder mediated by the target antigen. Thus, the present invention provides methods of screening for a candidate substance for treatment and/or prevention of a disease or disorder mediated by a target antigen.

VL, VH or VHH having a known sequence, for example, VL, VH or VHH having a sequence registered in the IMGT or Kabat database, can be used as the VL, the VH or the VHH that inhibits the antigen binding activity of the antigen binding domain. Also, a VL, VH or VHH sequence newly identified from a human antibody library or the like can be used. The VL, the VH or the VHH that inhibits the binding activity of the antigen binding domain can be selected by preparing a protein by the combination of these sequences and measuring the binding activity by use of the method described above.

In some embodiments of the present invention, VL, VH or VHH having a human antibody germline sequence can be used as the VL, the VH or the VHH that inhibits the antigen binding activity of the antigen binding domain. In the case of using, for example, VL as the inhibiting domain, VL having kappa chain framework sequences or VL having lambda chain framework sequences can be used. Also, VL having modified framework sequences such as combined framework sequences of kappa chain and lambda chain framework sequences can be used.

In one embodiment, the present invention provides a method for screening for an antigen binding domain whose antigen binding activity can be inhibited by associating with particular VL, comprising the following steps:

(a) obtaining an antigen binding domain having target antigen binding activity; (b) associating the antigen binding domain obtained in the step (a) with a particular VL; and (c) confirming that the binding activity of the antigen binding domain associated with the particular VL in the step (b) against the antigen is weakened or lost.

In the present invention, the phrase "binding activity is weakened" means that the binding activity against the target antigen is decreased as compared with that before the association, and the degree of this decrease is not limited.

In one embodiment, the present invention provides a method for screening for an antigen binding domain whose antigen binding activity can be inhibited by associating with particular VH, comprising the following steps:

(a) obtaining an antigen binding domain having target antigen binding activity;

(b) associating the antigen binding domain obtained in the step (a) with a particular VH; and (c) confirming that the binding activity of the antigen binding domain associated with the particular VH in the step (b) against the antigen is weakened or lost.

In the present invention, the phrase "binding activity is weakened" means that the binding activity against the target antigen is decreased as compared with that before the association, and the degree of this decrease is not limited.

In one embodiment, the present invention provides a method for screening for an antigen binding domain whose antigen binding activity can be inhibited by associating with particular VHH, comprising the following steps:
(a) obtaining an antigen binding domain having target antigen binding activity;
(b) associating the antigen binding domain obtained in the step (a) with a particular VHH; and
(c) confirming that the binding activity of the antigen binding domain associated with the particular VHH in the step (b) against the antigen is weakened or lost.

In the present invention, the phrase "binding activity is weakened" means that the binding activity against the target antigen is decreased as compared with that before the association, and the degree of this decrease is not limited.

Examples of the method for associating the antigen binding domain with the particular VL, VH or VHH include a method of designing a molecule having the sequence of the antigen binding domain as a substitute for the sequence of one of VH and VL in an antibody or an antibody fragment comprising both VH and VL, such as a complete antibody, Fab, Fab', or F(ab')2, and expressing a polypeptide having the sequence.

The present invention also relates to a method for producing an antigen binding domain whose antigen binding activity is inhibited by promoting the association of the antigen binding domain with particular VL, VH or VHH, promoting the association of the antigen binding domain with particular VL, promoting the association of the antigen binding domain with particular VH, or promoting the association of the antigen binding domain with particular VHH, in addition to screening for an antigen binding domain whose antigen binding activity is inhibited by associating with particular VL, associating with particular VH, or associating with particular VHH.

In one embodiment, the present invention provides a method for producing an antigen binding domain whose antigen binding activity is inhibited by associating with particular VL, comprising the following step:
(a) substituting an amino acid residue in an antigen binding domain that involves in association of the antigen binding domain with antibody VL, to prepare an antigen binding domain variant retaining the binding activity of the antigen binding domain against the target antigen.

In a particular embodiment, the present invention provides the method for producing an antigen binding domain whose antigen binding activity is inhibited by associating with particular VL, further comprising the following steps:
(b) associating the antigen binding domain variant prepared in the step (a) with the particular VL; and
(c) confirming that the antigen binding activity of the antigen binding domain variant associated with the VL is weakened or lost.

In the present invention, the phrase "binding activity is weakened" means that the binding activity against the target antigen is decreased as compared with that before the association, and the degree of this decrease is not limited.

In one embodiment, the present invention provides a method for producing an antigen binding domain whose antigen binding activity is inhibited by associating with particular VH, comprising the following step:
(a) substituting an amino acid residue in an antigen binding domain that involves in association of the antigen binding domain with antibody VH, to prepare an antigen binding domain variant retaining the binding activity of the antigen binding domain against the target antigen.

In a particular embodiment, the present invention provides the method for producing an antigen binding domain whose antigen binding activity is inhibited by associating with particular VH, further comprising the following steps:
(b) associating the antigen binding domain variant prepared in the step (a) with the particular VH; and
(c) confirming that the antigen binding activity of the antigen binding domain variant associated with the VH is weakened or lost.

In the present invention, the phrase "binding activity is weakened" means that the binding activity against the target antigen is decreased as compared with that before the association, and the degree of this decrease is not limited.

In one embodiment, the present invention provides a method for producing an antigen binding domain whose antigen binding activity is inhibited by associating with particular VHH, comprising the following step:
(a) substituting an amino acid residue in an antigen binding domain that involves in association of the antigen binding domain with VHH, to prepare an antigen binding domain variant retaining the binding activity of the antigen binding domain against the target antigen.

In a particular embodiment, the present invention provides the method for producing an antigen binding domain whose antigen binding activity is inhibited by associating with particular VHH, further comprising the following steps:
(b) associating the antigen binding domain variant prepared in the step (a) with the particular VHH; and
(c) confirming that the antigen binding activity of the antigen binding domain variant associated with the VHH is weakened or lost.

In the present invention, the phrase "binding activity is weakened" means that the binding activity against the target antigen is decreased as compared with that before the association, and the degree of this decrease is not limited.

The step of associating the antigen binding domain with the particular VL, VH or VHH is performed by a method of designing a molecule having the sequence of the antigen binding domain as a substitute for the sequence of one of VH and VL in an antibody or an antibody fragment comprising both VH and VL, such as a complete antibody, Fab, Fab', or F(ab')2, and expressing a polypeptide having the sequence.

According to a certain embodiment of the present invention, the antigen binding domain of the present invention whose antigen binding activity can be inhibited or could be lost by associating with particular VL, VH or VHH can be obtained from a library comprising a plurality of fusion polypeptides of antigen binding domains each linked to a first association sustaining domain.

In the present specification, an embodiment of the "library" can provide a library that permits efficient obtainment of an antigen binding domain whose antigen binding activity can be inhibited or could be lost by associating with particular VL, VH or VHH.

In the present specification, the "library" refers to a set of a plurality of fusion polypeptides having different sequences, or nucleic acids or polynucleotides encoding these fusion polypeptides. A plurality of fusion polypeptides contained in the library are fusion polypeptides differing in sequence from each other, not having a single sequence.

In the present specification, the term "differing in sequence from each other" in a plurality of fusion polypeptides differing in sequence from each other means that the individual fusion polypeptides in the library have distinct sequences. More preferably, the term means that the antigen binding domain moieties of the individual fusion polypeptides in the library have distinct sequences. Specifically, the number of the distinct sequences in the library reflects the number of independent clones differing in sequences in the library and is also referred to as a "library size". The library size of a usual phage display library is 106 to 1012 and may be expanded to 1014 by the application of a technique known in the art such as a ribosome display method. However, the actual number of phage particles for use in panning selection for the phage library is usually 10 to 10,000 times larger than the library size. This excessive multiple, also called the "number of equivalents of the library", represents that 10 to 10,000 individual clones may have the same amino acid sequence. Accordingly, the term "differing in sequence from each other" according to the present invention means that the individual polypeptides in the library excluding the number of equivalents of the library have distinct sequences and more specifically means that the library has 106 to 1014 molecules, preferably 107 to 1012 molecules, of polypeptides differing in sequence from each other.

The term "plurality of" in the library consisting essentially of a plurality of fusion polypeptides according to the present invention usually refers to a set of two or more types of substances as to, for example, the polypeptide, polynucleotide molecule, vector, or virus of the present invention. Provided that, for example, two or more substances differ in particular trait from each other, this means that the substances are of two or more types. Examples thereof can include a mutant amino acid observed at a particular amino acid position in an amino acid sequence. For example, two or more polypeptides of the present invention having substantially the same, preferably identical sequences, except for particular mutant amino acids at surface-exposed, highly diverse amino acid positions are regarded as a plurality of polypeptides of the present invention. In another example, two or more polynucleotide molecules of the present invention having substantially the same, preferably identical sequences except for bases encoding particular mutant amino acids at surface-exposed, highly diverse amino acid positions are regarded as a plurality of polynucleotide molecules of the present invention.

A panning method that utilizes phage vectors is also preferably used as a method for screening the fusion polypeptides with binding activity as an index. A gene encoding each antigen binding domain and a gene encoding an IgG antibody CH1 domain or a light chain constant region can be linked in an appropriate form to form a fusion polypeptide. Genes encoding the fusion polypeptides thus formed can be inserted into phage vectors to obtain phages expressing the fusion polypeptides on the surface. After contact of the phages with the desired antigen, phages bound with the antigen can be recovered to recover DNAs encoding fusion polypeptides having the binding activity of interest. This operation can be repeated, if necessary, to enrich fusion polypeptides having the desired binding activity.

In addition to the phage display method, a technique using a cell-free translation system, a technique of presenting or displaying fusion polypeptides on cell or virus surface, a technique of using an emulsion, and the like are known as techniques of obtaining fusion polypeptides by panning using a library. For example, a ribosome display method of forming a complex of mRNA and a translated protein via ribosome by the removal of a stop codon, etc., a cDNA or mRNA display method of covalently binding a gene sequence to a translated protein using a compound such as puromycin, or a CIS display method of forming a complex of a gene and a translated protein using a nucleic acid binding protein can be used as the technique using a cell-free translation system. For example, the phage display method as well as an $E.$ $coli$ display method, a gram-positive bacterium display method, a yeast display method, a mammalian cell display method, or a virus display method can be used as the technique of presenting or displaying fusion polypeptides on cell or virus surface. For example, an in vitro virus display method using an emulsion containing a gene and a translation-related molecule can be used as the technique using an emulsion. These methods are already known in the art (Nat Biotechnol. 2000 December; 18(12): 1287-92, Nucleic Acids Res. 2006; 34(19): e127, Proc Natl Acad Sci USA. 2004 Mar. 2; 101(9): 2806-10, Proc Natl Acad Sci USA. 2004 Jun. 22; 101(25): 9193$^{-8}$, Protein Eng Des Sel. 2008 April; 21(4): 247-55, Proc Natl Acad Sci USA. 2000 Sep. 26; 97(20): 10701-5, MAbs. 2010 September-October; 2(5): 508-18, Methods Mol Biol. 2012; 911: 183-98).

An association partner of an inhibiting domain linked to a second association sustaining domain can be used in a method for obtaining the antigen binding domain of interest from the library comprising a plurality of fusion polypeptides of antigen binding domains each linked to a first association sustaining domain.

In the present specification, the "first association sustaining domain" and the "second association sustaining domain" refer to domains that can interact with each other through a bond such as a hydrophobic bond, a hydrogen bond, or an ionic bond to form an associate. Preferred examples of the first association sustaining domain and the second association sustaining domain include, but are not limited to, an antibody light chain constant region (CL) and a CH1 domain of a heavy chain constant region.

The first association sustaining domain and the second association sustaining domain can interact with each other and form the association of the fusion polypeptide with the association partner, regardless of the degree of associativity between the antigen binding domain and the inhibiting domain.

In an alternative embodiment, the present invention provides a library comprising a plurality of fusion polypeptides of antigen binding domains linked to an IgG antibody light chain constant region, wherein the antigen binding domains include an antigen binding domain whose antigen binding activity can be inhibited or could be lost by associating with particular VL, VH or VHH, and a method for screening the library for an antigen binding domain whose antigen binding activity can be inhibited or could be lost by associating with particular VL, VH or VHH.

In a specific embodiment, as shown in FIGS. 9A(1), 9A(2), 9A(3), 9B, and 9C,
 (1) fusion polypeptides of antigen binding domains each linked to a first association sustaining domain are displayed on the surface of phages or the like by a display method such as phage display.
 (2) An association partner of an inhibiting domain linked to a second association sustaining domain is provided, and the fusion polypeptides are associated with the association partner. A fusion polypeptide that does not bind to the target antigen or has antigen binding activity of a predetermined value or lower in this state of the fusion polypeptide associated with the association partner is selected.

(3) The association of the antigen binding domain in the fusion polypeptide selected in (2) with the inhibiting domain in the association partner is canceled. A fusion polypeptide that binds to the target antigen or has antigen binding activity of a predetermined value or higher in a state where the antigen binding domain does not associate with the inhibiting domain is selected.

Figure 9B:
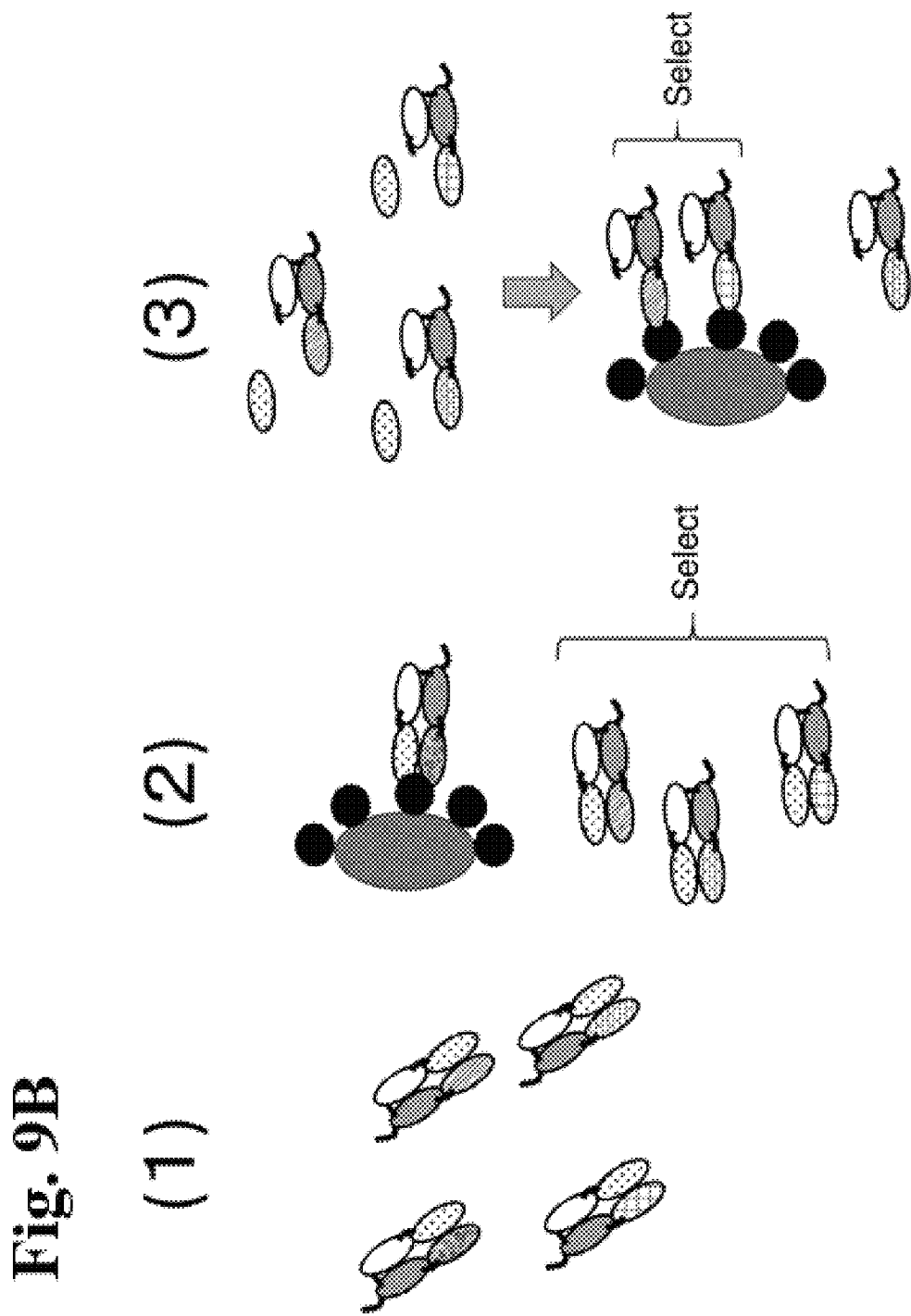

In this context, for example, a method of cleaving the association partner near the boundary between the inhibiting domain and the second association sustaining domain as shown in FIG. 9B, or a method of cleaving the fusion polypeptide near the boundary between the antigen binding domain and the first association sustaining domain as shown in FIG. 9C can be used as a method for canceling the association of the antigen binding domain with the inhibiting domain.

Figure 9D:
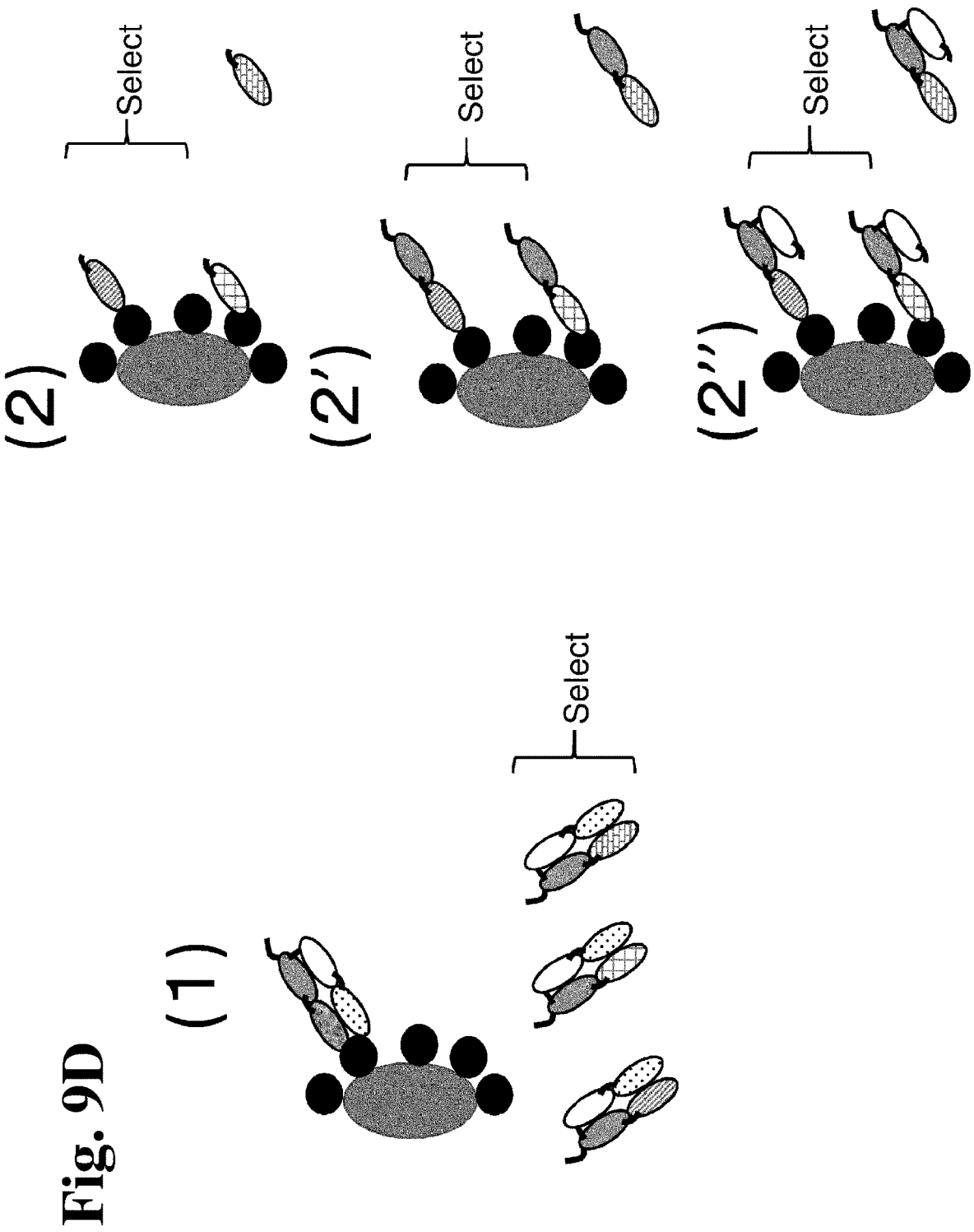

In a further embodiment, the present invention provides a method comprising, as shown in FIG. 9D, comparing the difference in the binding activity of the antigen binding domain between when the antigen binding domain and the inhibiting domain are expressed together and when the antigen binding domain is expressed so as not to express the inhibiting domain together therewith, instead of comparing the difference in the binding activity of the antigen binding domain between the canceled association and non-canceled association of the antigen binding domain with the inhibiting domain as shown in FIGS. 9A to 9C.

As shown in FIG. 9D(1), the antigen binding domain and the inhibiting domain are expressed together to form association. A fusion polypeptide comprising an antigen binding domain that does not bind to the antigen or has antigen binding activity of a predetermined value or lower in this state is selected. As shown in FIGS. 9D(2), 9D(2'), and 9D(2"), the antigen binding domain is expressed so as not to express the inhibiting domain together therewith. A fusion polypeptide comprising an antigen binding domain that binds to the antigen or has antigen binding activity of a predetermined value or higher in this state is selected. As a result, the antigen binding domain whose antigen binding activity can be inhibited or could be lost by associating with a particular inhibiting domain, for example, VH, VL or VHH may be screened for from the library comprising a plurality of fusion polypeptides of antigen binding domains each linked to a first association sustaining domain. Alternatively, the antigen binding domain is expressed so as not to express the inhibiting domain together therewith. A polypeptide comprising an antigen binding domain that binds to the antigen or has antigen binding activity of a predetermined value or higher in this state is selected. Then, the antigen binding domain and the inhibiting domain are expressed together to form association. A polypeptide comprising an antigen binding domain that does not bind to the antigen or has antigen binding activity of a predetermined value or lower in this state is selected. By this method as well, the antigen binding domain whose antigen binding activity can be inhibited or could be lost by associating with a particular inhibiting domain, for example, VH, VL or VHH may be screened for from the library comprising a plurality of fusion polypeptides of antigen binding domains each linked to a first association sustaining domain. Alternatively, as shown in FIGS. 9D(2), 9D(2'), and 9D(2"), the antigen binding domain is expressed so as not to express the inhibiting domain together therewith (only the antigen binding domain is expressed; only the fusion polypeptide comprising an antigen binding domain and a first association sustaining domain is expressed; or the fusion polypeptide comprising an antigen binding domain and a first association sustaining domain is associated only with the second association sustaining domain), and a fusion polypeptide comprising an antigen binding domain that binds to the antigen or has antigen binding activity of a predetermined value or higher in this state is selected. Then, as shown in FIG. 9D(1), the antigen binding domain in the selected fusion polypeptide and the inhibiting domain are expressed together to form association. A fusion polypeptide comprising an antigen binding domain that does not bind to the antigen or has antigen binding activity of a predetermined value or lower in this state is selected. As a result, the antigen binding domain whose antigen binding activity can be inhibited or could be lost by associating with a particular inhibiting domain, for example, VH, VL or VHH may also be screened for from the library comprising a plurality of fusion polypeptides of antigen binding domains each linked to a first association sustaining domain.

The "antigen binding activity of a predetermined value or lower" can refer to, for example, antigen binding activity that falls below a predetermined reference when the antigen binding activity is measured by the method listed in the present specification. Likewise, the "antigen binding activity of a predetermined value or higher" can refer to, for example, antigen binding activity that exceeds a predetermined reference when the antigen binding activity is measured by the method listed in the present specification. A fusion polypeptide having the antigen binding activity of a predetermined value or higher binds more strongly to the antigen than a fusion polypeptide having the antigen binding activity of a predetermined value or lower.

The fusion polypeptide selected in (3) described above comprises an antigen binding domain that has no or weak antigen binding activity in a state of association with the inhibiting domain and has (strong) antigen binding activity in a state of non-association with the inhibiting domain. The sequence of the fusion polypeptide selected by such a method can be analyzed to also elucidate the sequence of the antigen binding domain contained therein. Thus, the antigen binding domain can be produced.

For the method for screening for a fusion polypeptide comprising the antigen binding domain of interest by using fusion polypeptides and an association partner, it is important to compare the antigen binding activity of the antigen binding domain between states of association and non-association with the inhibiting domain. As shown in FIGS. 9A(2') and 9A(3'), the antigen binding activity of the displayed fusion polypeptides is first confirmed, and a fusion polypeptide that binds to the antigen or has antigen binding activity of a predetermined value or higher is selected. Then, the fusion polypeptides thus selected are associated with the association partner. A fusion polypeptide that does not binds to the antigen or has antigen binding activity of a predetermined value or lower in this state of association is selected. By this method as well, the fusion polypeptide comprising the antigen binding domain of interest can be obtained.

Hereinafter, some embodiments using an IgG antibody CH1 domain as the first association sustaining domain and using IgG antibody CL as the second association sustaining domain will be described.

A fusion polypeptide comprising the antigen binding domain of interest can be screened for from a library comprising a plurality of fusion polypeptides of antigen binding domains each linked to an IgG antibody CH1 domain.

In some embodiments, the present invention provides a library comprising a plurality of fusion polypeptides of antigen binding domains each linked to an IgG antibody CH1 domain, wherein the antigen binding domains include an antigen binding domain whose antigen binding activity is can be inhibited or could be lost by associating with particular VL, VH or VHH, and a method for screening the library for a fusion polypeptide comprising an antigen binding domain whose antigen binding activity can be inhibited or could be lost by associating with particular VL, VH or VHH.

In a particular embodiment, the present invention provides a method for screening for a fusion polypeptide comprising an antigen binding domain whose antigen binding activity can be inhibited or could be lost by associating with particular VL, from a library comprising a plurality of fusion polypeptides of antigen binding domains each linked to an IgG antibody CH1 domain. Specifically, the present invention provides a method for screening for an antigen binding domain, comprising the following steps:
(a) in vitro displaying the fusion polypeptides of the library according to the present invention;
(b) providing an association partner of an IgG antibody light chain constant region fused with the particular VL;
(c) associating the fusion polypeptides displayed in the step (a) with the association partner provided in the step (b) and selecting a fusion polypeptide that does not bind to the antigen or has antigen binding activity of a predetermined value or lower in a state where the antigen binding domain associates with the VL; and
(d) selecting, from the fusion polypeptides thus selected in the step (c), a fusion polypeptide that binds to the antigen or has antigen binding activity of a predetermined value or higher in a state where the antigen binding domain contained therein does not associate with the VL.

The association partner provided in the step (b) further comprises a protease cleavage sequence. In this case, in the step (d), the association of the antigen binding domain with the VL is canceled by protease treatment, and the antigen binding activity of the antigen binding domain may be confirmed in a state where the antigen binding domain does not associate with the VL. The protease cleavage sequence in the association partner is not limited by its position as long as the association of the antigen binding domain with the VL is canceled by cleavage. As an example of the position, the protease cleavage sequence may be located, for example, near the boundary between the VL and the IgG antibody light chain constant region in the association partner, preferably at any position between amino acid position 96 (Kabat numbering) of the VL and amino acid position 130 (EU numbering) (Kabat numbering position 130) of the antibody light chain constant region, more preferably at any position between amino acid position 104 (Kabat numbering) of the VL and amino acid position 113 (EU numbering) (Kabat numbering position 113) of the antibody light chain constant region.

Instead of using the association partner comprising a protease cleavage sequence, the protease cleavage sequence may be introduced into the fusion polypeptides in the library, and the fusion polypeptides can be cleaved by protease so that the association of the antigen binding domain with the VL is canceled. The protease cleavage sequence in each fusion polypeptide is not limited by its position as long as the association of the antigen binding domain with the VL is canceled by cleavage and the antigen binding domain retains its antigen binding activity even after the cleavage. As an example of the position, the protease cleavage sequence may be located, for example, near the boundary between the antigen binding domain and the IgG antibody CH1 domain in the fusion polypeptide.

In the step (d), the full lengths of the fusion polypeptides selected in the step (c) or their moieties comprising the antigen binding domains may be displayed again, and the antigen binding activity of the antigen binding domain can be confirmed in a state where the antigen binding domain does not associate with the VL.

In a particular embodiment, the present invention provides a method for screening for a fusion polypeptide comprising an antigen binding domain whose antigen binding activity can be inhibited or could be lost by associating with particular VH, from a library comprising a plurality of fusion polypeptides of antigen binding domains each linked to an IgG antibody light chain constant region. Specifically, the present invention provides a method for screening for a fusion polypeptide comprising an antigen binding domain, comprising the following steps:
(a) in vitro displaying the fusion polypeptides of the library according to the present invention;
(b) providing an association partner of an IgG antibody CH1 domain fused with the particular VH;
(c) associating the fusion polypeptides displayed in the step (a) with the association partner provided in the step (b) and selecting a fusion polypeptide that does not bind to the antigen or has antigen binding activity of a predetermined value or lower in a state where the antigen binding domain associates with the VH; and
(d) selecting, from the fusion polypeptides thus selected in the step (c), a fusion polypeptide that binds to the antigen or has antigen binding activity of a predetermined value or higher in a state where the antigen binding domain contained therein does not associate with the VH.

The association partner provided in the step (b) further comprises a protease cleavage sequence. In this case, in the step (d), the association of the antigen binding domain with the VH is canceled by protease treatment, and the antigen binding activity of the antigen binding domain may be confirmed in a state where the antigen binding domain does not associate with the VH. The protease cleavage sequence in the association partner is not limited by its position as long as the association of the antigen binding domain with the VH is canceled by cleavage. As an example of the position, the protease cleavage sequence may be located, for example, near the boundary between the VH and the IgG antibody CH1 domain in the association partner, preferably at any position between amino acid position 101 (Kabat numbering) of the VH and amino acid position 140 (EU numbering) of the antibody heavy chain constant region, more preferably at any position between amino acid position 109 (Kabat numbering) of the VH and amino acid position 122 (EU numbering) of the antibody heavy chain constant region.

Instead of using the association partner comprising a protease cleavage sequence, the protease cleavage sequence may be introduced into the fusion polypeptides in the library, and the fusion polypeptides can be cleaved by protease so that the association of the antigen binding domain with the VH is canceled. The protease cleavage sequence in each fusion polypeptide is not limited by its position as long as the association of the antigen binding domain with the VH is canceled by cleavage and the antigen binding domain retains its antigen binding activity even after the cleavage. As an example of the position, the protease cleavage sequence may be located, for example, near the boundary between the antigen binding domain and the IgG antibody light chain constant region in the fusion polypeptide.

In the step (d), the full lengths of the fusion polypeptides selected in the step (c) or their moieties comprising the antigen binding domains may be displayed again, and the antigen binding activity of the antigen binding domain can be confirmed in a state where the antigen binding domain does not associate with the VH.

An amino acid contained in each amino acid sequence described in the present invention may be posttranslationally modified (e.g., the modification of N-terminal glutamine to pyroglutamic acid by pyroglutamylation is a modification well known to those skilled in the art). Such an amino acid sequence containing the posttranslationally modified amino acid is also included in the amino acid sequence described in the present invention, as a matter of course.

The present invention also relate to an antibody that binds to aggrecan. As shown in Examples of the specification, anti-aggrecan antibodies can penetrate into a deeper zone of cartilage tissue, and retain in the cartilage tissue for a long period. Anti-aggrecan antibodies can also inhibit proteolytic cleavage of aggrecan. An anti-aggrecan antibody of the present invention is useful as a carrier which delivers a drug molecule to a cartilage tissue and retains in the cartilage for a long period. An anti-aggrecan antibody of the present invention is also useful as a pharmaceutical which effectively prevent degradation of aggrecan.

In a particular embodiment, the anti-aggrecan antibody of the present invention is anti-Aggrecan antibody which competes for binding to Aggrecan with an antibody selected from the group consisting of:
  1) An antibody comprising VH sequence of SEQ ID NO: 512 and VL sequence of SEQ ID NO: 513,
  2) An antibody comprising VH sequence of SEQ ID NO: 514 and VL sequence of SEQ ID NO: 515, and
  3) An antibody comprising VH sequence of SEQ ID NO: 516 and VL sequence of SEQ ID NO: 517.

As mentioned above, the competition between the antigen binding domains can be detected by cross-blocking assay or the like. In the present invention, the competition level for binding may be at least 10%, preferably at least 10%, more preferably at least 20 to 50%, more preferably at least 50% as compared with binding activity obtained in a control test carried out in the absence of the competitor.

In one embodiment, the anti-aggrecan antibody of the present invention is an anti-aggrecan antibody which binds to an epitope selected from the group consisting of 1) to 2) below:
  1) amino acids at positions 377-386 of the amino acid sequence set forth in SEQ ID NO: 509,
  2) amino acids at positions 48-673 (G1-IGD-G2 Domain) of the amino acid sequence set forth in SEQ ID NO: 509.

In one embodiment, the anti-aggrecan antibody of the present invention is an anti-aggrecan antibody which binds to an epitope within amino acids at positions 377-386 of the amino acid sequence set forth in SEQ ID NO: 509 and competes for binding the epitope with an antibody selected from the group consisting of 1) below:
  1) An antibody comprising VH sequence of SEQ ID NO: 512 and VL sequence of SEQ ID NO: 513.

In one embodiment, the anti-aggrecan antibody of the present invention is an anti-aggrecan antibody which binds to an epitope within amino acids at positions 48-673 of the amino acid sequence set forth in SEQ ID NO: 509 and competes for binding the epitope with an antibody selected from the group consisting of 1) below:
  1) An antibody comprising VH sequence of SEQ ID NO: 514 and VL sequence of SEQ ID NO: 515.

In one embodiment, the anti-aggrecan antibody of the present invention is an anti-aggrecan antibody which binds to an epitope within amino acids at positions 48-673 of the amino acid sequence set forth in SEQ ID NO: 509 and competes for binding the epitope with an antibody selected from the group consisting of 1) below:
  1) An antibody comprising VH sequence of SEQ ID NO: 516 and VL sequence of SEQ ID NO: 517.

These antibodies can be obtained by producing antibodies using a polypeptide comprising the amino acid sequence shown above or its partial amino acid sequence as an antigen.

Still in one embodiment, the antibody of the present invention is an antibody which comprises one or more antigen binding domains in which the amino acid sequence of the antigen binding domains are highly identical to that of the antibodies described in Examples of the specification. For example, the antibody of the present invention is an antibody which comprises (a) a VH sequence having at least 95% sequence identity to the amino acid sequence of SEQ ID NO: 512 or 514 and/or (b) a VL sequence having at least 95% sequence identity to the amino acid sequence of SEQ ID NO: 513 or 515. For example, the antibody of the present invention is an antibody which comprises (a) a VH sequence having at least 95% sequence identity to the amino acid sequence of SEQ ID NO: 516 and/or (b) a VL sequence having at least 95% sequence identity to the amino acid sequence of SEQ ID NO: 517. For example, the antibody of the present invention comprises any one of the combinations of H-chain CDR1, CDR2, and CDR3 and L-chain CDR1, CDR2, and CDR3 selected from 1) to 3) below, or any one of the combinations of H-chain CDR1, CDR2, and CDR3 and L-chain CDR1, CDR2, and CDR3 of antibody variable regions functionally equivalent thereto:
  1) H-chain CDR1, CDR2, and CDR3 comprised in the antibody variable region are identical to the amino acid sequences of the CDR1, CDR2, and CDR3 regions comprised in SEQ ID NO:512; and L-chain CDR1, CDR2, and CDR3 comprised in the antibody variable region are identical to the amino acid sequences of the CDR1, CDR2, and CDR3 regions comprised in SEQ ID NO:513;
  2) H-chain CDR1, CDR2, and CDR3 comprised in the antibody variable region are identical to the amino acid sequences of the CDR1, CDR2, and CDR3 regions comprised in SEQ ID NO:514; and L-chain CDR1, CDR2, and CDR3 comprised in the antibody variable region are identical to the amino acid sequences of the CDR1, CDR2, and CDR3 regions comprised in SEQ ID NO:515; and
  3) H-chain CDR1, CDR2, and CDR3 comprised in the antibody variable region are identical to the amino acid sequences of the CDR1, CDR2, and CDR3 regions comprised in SEQ ID NO:516; and L-chain CDR1, CDR2, and CDR3 comprised in the antibody variable region are identical to the amino acid sequences of the CDR1, CDR2, and CDR3 regions comprised in SEQ ID NO:517.

Still in one embodiment, the antibody of the present invention comprises any one of the combinations of H-chain CDR1, CDR2, and CDR3 and L-chain CDR1, CDR2, and CDR3 of antibody variable regions selected from 1) to 3) below, or antibody variable regions functionally equivalent thereto:

1) An antibody H-chain variable region comprising the amino acid sequences of SEQ ID NO:512; and an antibody L-chain variable region comprising the amino acid sequences of SEQ ID NO:513;
2) An antibody H-chain variable region comprising the amino acid sequences of SEQ ID NO:514; and an antibody L-chain variable region comprising the amino acid sequences of SEQ ID NO:515; and
3) An antibody H-chain variable region comprising the amino acid sequences of SEQ ID NO:516; and an antibody L-chain variable region comprising the amino acid sequences of SEQ ID NO:517.

The present invention also relates to a pharmaceutical composition comprising the polypeptide or antibody of the present invention described above. The present invention also relates to a method for treating a subject having an Aggrecan mediated disease or disorder comprising administering to the subject an effective amount of the polypeptide or antibody of the present invention described above. The present invention also relates to a method for treating a subject having osteoarthritis (OA) comprising administering to the subject an effective amount of the polypeptide or antibody of the present invention described above. The present invention also relates to a method for preventing cartilage degradation of a subject in osteoarthritis (OA) comprising administering to the subject an effective amount of the polypeptide or antibody of the present invention described above.

Still in one embodiment, the present invention also relates to antibodies that bind to a molecule present in a cartilage tissue, wherein the molecule is not a soluble antigen. The antibodies of the present invention are useful for penetrating into deeper regions of cartilage tissue, and retaining in the cartilage tissue for a long period. The molecular weight of the antibody is not particularly limited. Preferably, the molecular weight of the antibody is 120 kDa or smaller, 100 kDa or smaller, 80 kDa or smaller, 60 kDa or smaller, 40 kDa or smaller, or 20 kDa or smaller. The antibody can be any type of antibody, including but not limited to F(ab')2, Fab, scFv, VHH, VL, VH or single domain antibody.

The antigen which the antibody of the present invention binds is not particularly limited. Preferably, the antigen is an extracellular matrix in the cartilage tissue, including but not limited to collagen, proteoglycan, glycoprotein, sugar chain, and other proteins. Collagen except for Collagen type II is preferable as an antigen for the antibody. Firillar collagen is also preferable as an antigen.

Examples of preferable antigens include, but not limited to, Collagen type II(fibrillar collagen), Collagen type III (fibrillar collagen), Collagen type IV, Collagen type V(fibrillar collagen), Collagen type VI, Collagen type IX, Collagen type X, Collagen type XI(fibrillar collagen), Collagen type XII, Collagen type XIV, Collagen type XVI, Collagen type XXII, Collagen type XXIV(fibrillar collagen), and Collagen type XXVII (fibrillar collagen). Examples of preferable antigen proteoglycans include, but not limited to, Aggrecan, Vercican, Perlecan, Syndecan, Lubricin, Link protein, and Small leucine-rich repeat proteoglycans. A protein linked with proteoglycans selected from the group consisting of Aggrecan, Vercican, Perlecan, Syndecan, Lubricin is also a preferable antigen in the present invention. Further examples of preferable antigen proteoglycans include, but not limited to, Decorin, Biglycan, Asporin, Fibromodulin, Lumican, Keratocan, Osteoadherin, Proline-/arginine-rich end leucine-rich repeat protein, Epiphycan, Mimecan, Opticin, Chondroadherin, and Chondroadherin-like. Examples of preferable antigen sugar chain include, but not limited to, Hyaluronic acid (HA), Chondroitin sulfate (CS), Keratan sulfate (KS), and Dermatan sulfate (DS). Examples of preferable antigens further includes extracellular matrix in the cartilage tissue such as Thrombospondin, Matrilin, WARP, UCMA, CILP, Fibronectin, Lamin, and Nidgen.

Examples of preferable antigen molecules also include a membrane antigen or an Extracellular matrix in the cartilage tissue. The half-life of the molecule is not limited as mentioned above. Preferably, the half-life of the molecule in the cartilage tissue is 1 month or more, 2 month or more, 6 month or more, 1 year or more, or 5 year or more. The relative amount (% wet weight) of the molecule in the cartilage tissue can, for example, be 1% or more, 2% or more, 3% or more, 4% or more, 5% or more, 10% or more, 15% or more, or 20% or more. Specific examples of the antigen molecule are aggrecan and collagen. Aggrecan is one of the most preferable antigen molecules in the present invention.

In one embodiment, the present invention relates to a method for penetrating into and/or retaining in a cartilage tissue of an antibody, characterized by using the antibody of the present invention described above. In one embodiment, the present invention relates to a pharmaceutical composition for use in penetrating into and/or retaining in a cartilage tissue of an antibody, characterized by using the antibody of the present invention described above. The antibody of the present invention has an excellent ability of penetrating into a cartilage. The antibody of the present invention has also an ability of retaining in a cartilage tissue for a long period. The antibody of the present invention is useful for derivernig the desired molecule to a cartilage tissue antibody. Any desired molecule can be carried by the antibody using a conventional technique, such as cross-linking, antigen-antibody binding, a fusion protein preparation, or a like. The antibody used for said method is not limited. As mentioned above, the molecular weight of the antibody is preferably less than that of a whole IgG type antibody. For example, the molecular weight of the antibody is less than 80 kDa or smaller, 60 kDa or smaller, 40 kDa or smaller, or 20 kDa or smaller. Type of the antibody is also not limited. For example, the antibody is F(ab')2, Fab, scFv, VHH, VL, VH or single domain antibody.

The present invention further relates to a method for increasing penetration rate into a cartilage tissue of an antibody which binds to a molecule present in the cartilage issue, comprising modifying a parent antibody binding to the same molecule so as to decrease the molecular weight of the parent antibody while substantially maintaining the binding ability to the molecule. Another embodiment of the present invention is a method for producing an antibody having an increased penetration rate into a cartilage tissue, which binds to a molecule present in a cartilage tissue, comprising modifying a parent antibody binding to the same molecule so as to decrease the molecular weight of the parent antibody while substantially maintaining the binding ability to the molecule. Another embodiment of the present invention is a method for producing an pharmaceutical composition having an increased penetration rate into a cartilage tissue, which binds to a molecule present in a cartilage tissue, comprising modifying a parent antibody binding to the same molecule so as to decrease the molecular weight of the parent antibody while substantially maintaining the binding ability to the molecule. Still another embodiment of the present invention is a method for increasing retention time in a cartilage tissue of an antibody which binds to a molecule present in the cartilage issue, comprising modifying a parent antibody binding to the same molecule so as to decrease the molecular weight of the parent antibody while substantially maintaining the binding ability to the molecule. Another embodiment of the present invention is a method for producing an antibody having an increased retention time in a cartilage tissue, which binds to a molecule expressed in the cartilage tissue, comprising modifying a parent antibody binding to the same molecule so as to decrease the molecular weight of the parent antibody while substantially maintaining the binding ability to the same molecule. Another embodiment of the present invention is a method for producing an pharmaceutical composition having an increased retention time in a cartilage tissue, which binds to a molecule expressed in the cartilage tissue, comprising modifying a parent antibody binding to the same molecule so as to decrease the molecular weight of the parent antibody while substantially maintaining the binding ability to the same molecule.

The retention capability in a cartilage tissue of an antibody (e.g. Fab) which binds to a molecule can be measured, for example, as follows.

To evaluate retention capability of Fabs which bind to aggrecan, remained Fab concentration in cartilage for 6 days after 1 day exposure of Fabs to cartilage. Initial Fab concentration into cartilage is evaluated immediately after 1 day Fab incubation. To evaluate remained Fab concentration in cartilage, cartilage is washed by cold PBS after 1 day incubation, followed by incubation for 6 days in fresh medium. Three cartilages can be used for each experiment. Fab retention capability is evaluated by comparison the Fab cartilage concentration between initial and remained into cartilage. Harvested cartilage is dissolved in low pH buffer (10 mM citric acid-HCl pH3, 150 mM NaCl and 1% Tween 20) and then homogenized with a Retsch MM400 homogenizer. Fab concentration is quantified by ECLIA with anti-human IgG (Fab specific from Sigma) coated on plate and SULFO tag-labeled anti-human IgG (H+L from Novus) as a detection antibody. The Fab retention is determined by the following formula.

[Fab retention]=[Fab concentration of 6 days after incubation]/[Initial Fab concentration]

In a particular embodiment, the polypeptide, antigen binding domain, antibody, VHH, Fab and so on provided in the present specification can have the retention capability into cartilage ([Fab retention] mentioned above) over 0.01, 0.03, 0.05, 0.1, 0.2, 0.3 0.4, 0.5, 0.6, 0.7, 0.8, 0.9 or ever more.

In certain embodiment, the retention capability into cartilage ([Fab retention]mentioned above) of the polypeptide, antigen binding domain, antibody, VHH, Fab and so on provided in the present specification, is the same or greater than that of the reference antibody selected from the group consisting of 1) to 14) below.

1) GRA1013hzqz-SG1 Fab,
2) GRA0105gg-SG1 Fab,
3) GRA0124cc-SG1 Fab,
4) GRA0124c0626c0544-SG1 Fab,
5) GRA0124c0626c0694-SG1 Fab,
6) GRA0124c0626c0951-SG1 Fab,
7) GRA0124c1075c0952-SG1 Fab,
8) GRA0124ccAE02-SG1/SK2 Fab,
9) GRA0124ccAE02-SG1265/SK2 Fab,
10) GRA0124ccAE02-SG1286/SK2 Fab,
11) GRA0124ccAE02-SG1/SK2021 Fab,
12) GRA0124ccAE02-SG1265/SK2021 Fab,
13) GRA0124ccAE02-SG1286/SK2025 Fab, and
14) GRA0124ccAE02-SG1265/SK2027 Fab, respectively.

In a further embodiment, the polypeptide, antigen binding domain, antibody, VHH, Fab and so on provided in the present specification which have the retention capability mentioned above, can preferably have the ratio of the uptake (nmol/g cartilage) mentioned below (see the next paragraph) for itself to the negative control VHHs (SD_RSV191D3-GSHIS/VLn-CLn(SEQ ID: 545) or SD_RSV191D3-HIS-FLAG/VLn-CLn(SEQ ID: 546)) over 1.1, 1.2, 1.3, 1.5, 2.0, 5.0, 7.0, 10.0, 15.0, 20.0 or ever more.

The penetration capability in a cartilage tissue of an antibody which binds to a molecule can be measured, for example, as follows.

To evaluate the penetration capability of the antibody, cartilage penetration of antibodies can be conducted in rabbit cartilage ex vivo. Two millimeter cartilage disks punched from rabbit femoral condyle are used in this experiment. AF488 (Life Technologies, A20181) labelled antibodies are diluted in Dulbecco's Modified Eagle Medium (DMEM) supplemented with 10% fetal bovine serum and 1% Penicillin-Streptomycin before adding to individual cartilage at final concentration of 7 micromolar. Antibodies treated rabbit cartilages are incubated at 37 degrees C. for 24 hours, after that, washed twice with PBS. Cartilages are embedded individually into cryo-blocks and sections are mounted on glass slides and counter stained with DAPI. Slides are imaged in X-Y plane using a confocal microscope (Nikon A1+) at 10× magnification. AF488 dye is excited using 488 nm laser and DAPI is excited with 405 nm laser. Laser power and photomultiplier tube (PMT) settings are kept constant between samples, except that when taking higher intensity images, laser power is adjusted slightly.

To evaluate the penetration capacity of the antibody (e.g. VHH and so on), uptake of VHHs and negative control VHHs (anti-RSV VHHs) are evaluated using rabbit cartilage explant culture obtained from white rabbits cartilage (Kbl: JW, male, 15 weeks) to reveal VHH penetration into cartilage. VHHs which binds to an antigen of interest, and negative control VHHs, are applied to rabbit cartilage explant culture at a concentration of 0.5 and 5 nmol/mL. After 24 hours, medium is removed, and cartilage is washed by phosphate buffered saline, then cartilage is collected. After that the cartilage disc is dissolved by 0.3 M acetic acid buffer (Wako) and homogenized with a homogenizer (Yasui Kikai). After centrifugation of homogenate, the supernatant is diluted by 1 M Tris-HCl (Dojindo) and PBS-T (Sigma Alfrich). Concentrations of VHHs in cartilage disc are measured by the electro chemiluminescence immunoassay (ECLIA) using aggrecan protein or RSV protein for coating and anti-alpaca antibody for detection.

In a particular embodiment, the antibody (e.g. VHH and so on) provided in the present specification can have the ratio of the uptake (nmol/g cartilage) mentioned above for itself to the negative control VHHs (SD_RSV191D3-GSHIS/VLn-CLn (SEQ ID: 545) or SD_RSV191D3-HIS-FLAG/VLn-CLn (SEQ ID: 546)) over 1.1, 1.2, 1.3, 1.5, 2.0, 5.0, 7.0, 10.0, 15.0, 20.0 or ever more.

Preferable properties of the antibodies of the invention and molecules present in the cartilage issue are the same as described above. In a preferable embodiment, the parent antibody is a whole IgG type antibody, and an antibodies having a smaller molecular weight, for example, antibodies having the molecular weight of 80 kDa or less, 60 kDa or less, 40 kDa or less, or 20 kDa or less, can be obtained. For example, obtained antibody is F(ab')2, Fab, scFv, VHH, VL, VH or single domain antibody.

In a preferred embodiment, the antigen molecule is a membrane antigen in the cartilage tissue or an Extracellular matrix in the cartilage tissue as mentioned above. The half-life of the molecule in the cartilage tissue is not limited, and preferably, 1 month or more, 2 month or more, 6 month or more, 1 year or more, or 5 year or more. The relative amount (% wet weight) of the molecule in the cartilage tissue can, for example, be 1% or more, 2% or more, 3% or more, 4% or more, 5% or more, 10% or more, 15% or more, or 20% or more. Specific examples of the antigen molecule are aggrecan and collagen. Aggrecan is one of the most preferable antigen molecules in the present invention.

The present invention also relates to the polypeptide of the present invention for use in penetrating into and/or retaining in a cartilage tissue, wherein the polypeptide has an ability to bind to a molecule present in the cartilage tissue, and wherein the polypeptide has the molecular weight less than that of a whole IgG type antibody; for example, the polypeptide has the molecular weight of 80 kDa or less, 60 kDa or less, 40 kDa or less, or 20 kDa or less.

The present invention further relates to a polypeptide comprising:
  (a) an antibody which binds to a molecule present in a cartilage tissue, and
  (b) an antigen-binding domain which binds to a molecule present in the cartilage tissue, which is not the molecule that the antibody binds.

The polypeptide above has a bi-specific binding property which binds two different sites in a cartilage tissue. These two binding sites can be located in the same molecule in a cartilage tissue; alternatively, two binding sites may be located in different molecules in a cartilage tissue.

In one embodiment, the antibody of (a) is an antibody that inhibits ADAMTS4/5 activity, NGF activity, or IL1R1 activity, or enhances BMP7 agonist activity, TGFb1 agonist activity, or FGF18 agonist activity. In one embodiment, either of the molecule of (a) or the molecule of (b) is not a soluble antigen. In another embodiment, both of the molecule of (a) and the molecule of (b) are not a soluble antigen. The molecular weight of the polypeptide is not limited, for example, 120 kDa or less, 100 kDa or less, 80 kDa or less, 60 kDa or less, 50 kDa or less, 40 kDa or less, 30 kDa or less, or 20 kDa or less. The type of the antibody is also not particularly limited. For example, the antibody can be, but not limited to, whole IgG type antibody, F(ab')2, Fab, scFv, VHH, VL, VH or single domain antibody. Examples of a preferable antigen molecule referred in (a) and/or (b) can be, but not limited to, a membrane antigen or an Extracellular matrix in the cartilage tissue. The half-life of the molecule referred in (a) and/or (b) is not limited, and preferably, 1 month or more, 2 month or more, 6 month or more, 1 year or more, or 5 year or more. The relative amount (% wet weight) of the molecule referred in (a) and/or (b) may be, for example, 1% or more, 2% or more, 3% or more, 4% or more, 5% or more, 10% or more, 15% or more, or 20% or more. Specific examples of the molecule referred in (a) and/or (b) are aggrecan and collagen.

In one embodiment, the polypeptide above of the present invention is useful for delivering functional antibodies to cartilage tissue and retaining them in the cartilage for a long period.

It should be understood by those skilled in the art that arbitrary combinations of one or more embodiments described in the present specification are also included in the present invention unless there is technical contradiction on the basis of the technical common sense of those skilled in the art.

EXAMPLES

Hereinafter, Examples of the method and the composition of the present invention will be described. It shall be understood that various other embodiments can be carried out in light of the general description mentioned above.

Example 1 Problem of Existing Protease-Activated Antibody

Figure 1:
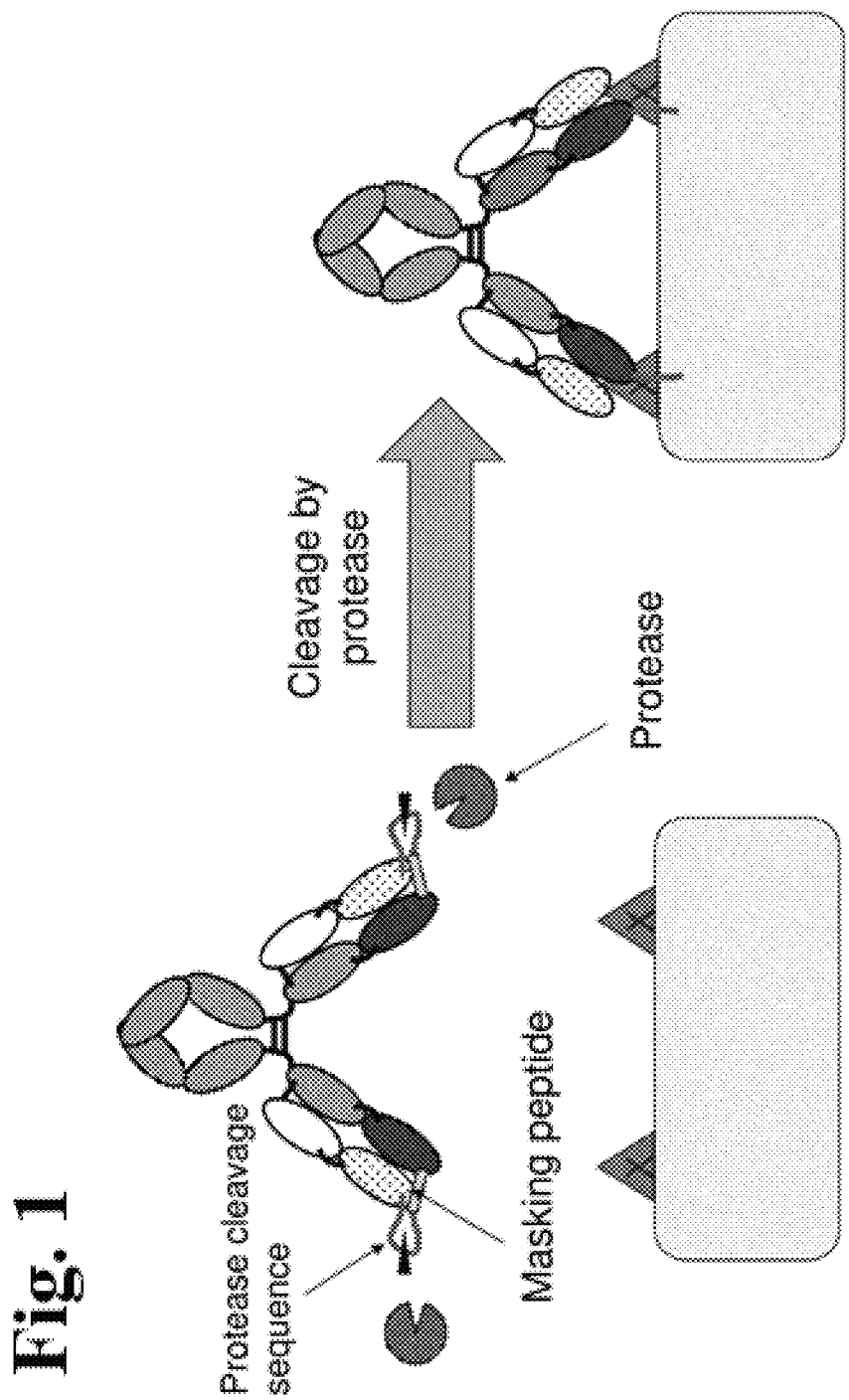

A method for preparing an antibody that exerts antigen binding activity only through cleavage by protease expressed at a lesion site such as a cancer tissue or an inflammatory tissue has been reported. This antibody, called Probody, is an antibody molecule, as shown in FIG. 1, whose antigen binding activity is inhibited by connecting an antibody to a peptide masking the antigen binding site of the antibody via a linker that is cleaved by protease expressed at a lesion site (NPL 18). The masking peptide is dissociated from the Probody by the cleavage of the constituent linker by the protease expressed at the target pathological site so that the resulting antibody molecule restores its antigen binding activity and becomes capable of binding to the antigen in the target pathological tissue.

Figure 2:
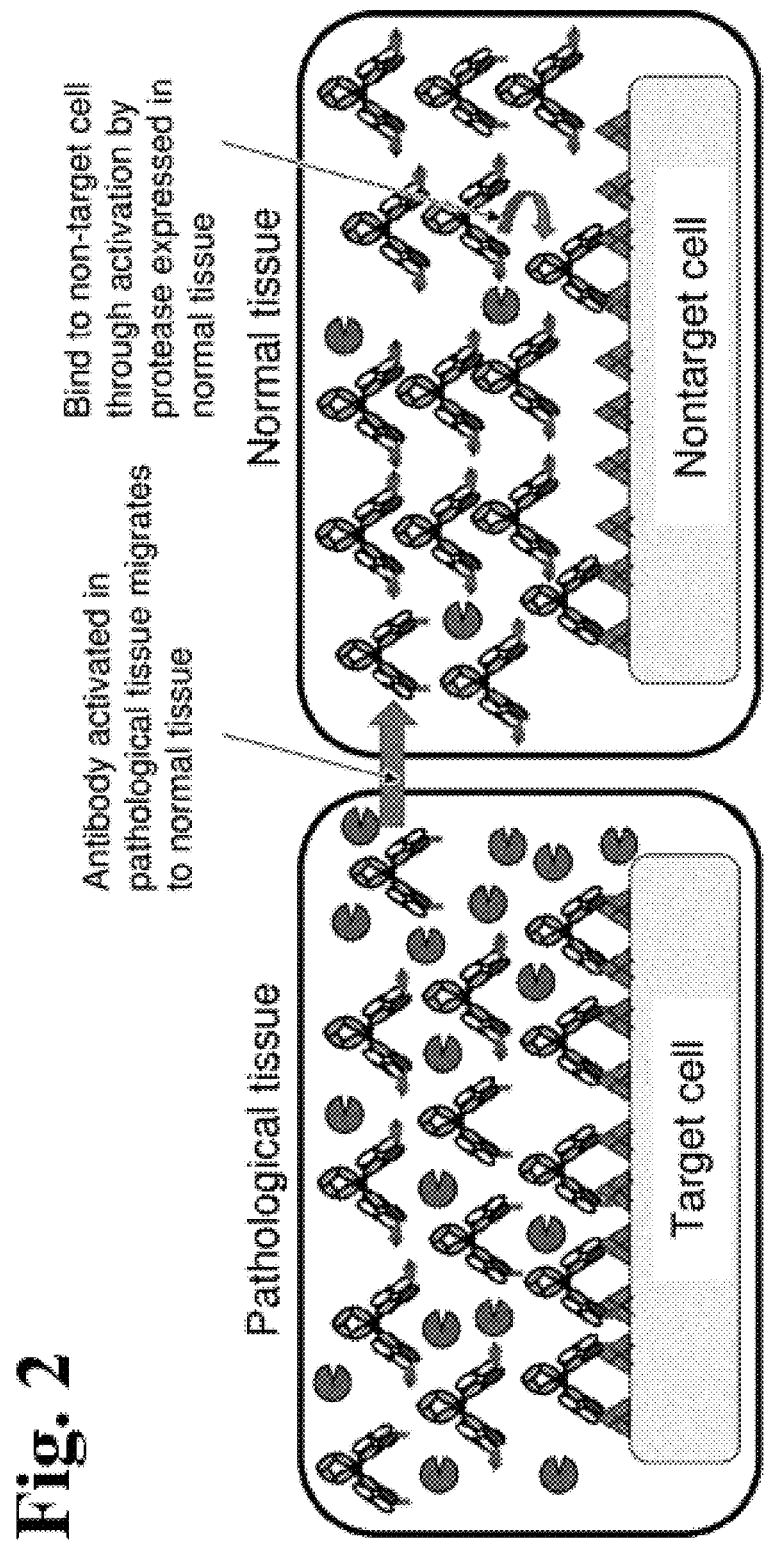

It is believed that the Probody can bind to the antigen selectively at the target pathological site under the mechanism as mentioned above and thereby expand the therapeutic window. However, for the Probody, there may be the possibility that the antibody cleaved at the pathological site is capable of being brought back into blood from the pathological site and binds to the antigen expressed in normal tissue as a result of distributing the antibody to the normal tissues through blood flow, because the cleavage of the antibody by protease is irreversible. The Probody activated by protease retains a Fc region as in the Probody before the activation and therefore possesses a long circulation time in blood. Therefore, the antibody activated by protease expressed at a pathological site might circulate long in blood. Even protease expressed at an elevated level at a pathological site is also expressed at a low level in normal tissues, and free protease produced at a pathological site may be leaked into blood (The Chinese-German Journal of Clinical Oncology June 2004, Vol. 3, No. 2 P78-P80). Therefore, the Probody may be activated by such free protease. Hence, there may be a possibility that the Probody is activated at a site other than a pathological site. The Probody thus activated also circulates long in blood. Thus, there is a possibility that the Probody is continuously activated at a pathological site, in normal tissues, and in blood, and the activated Probody, if having a long circulation time in blood, accumulates in blood. The activated Probody accumulated in blood might exhibit adverse reactions by binding to the antigen expressed in normal tissues (FIG. 2).

Figure 3:
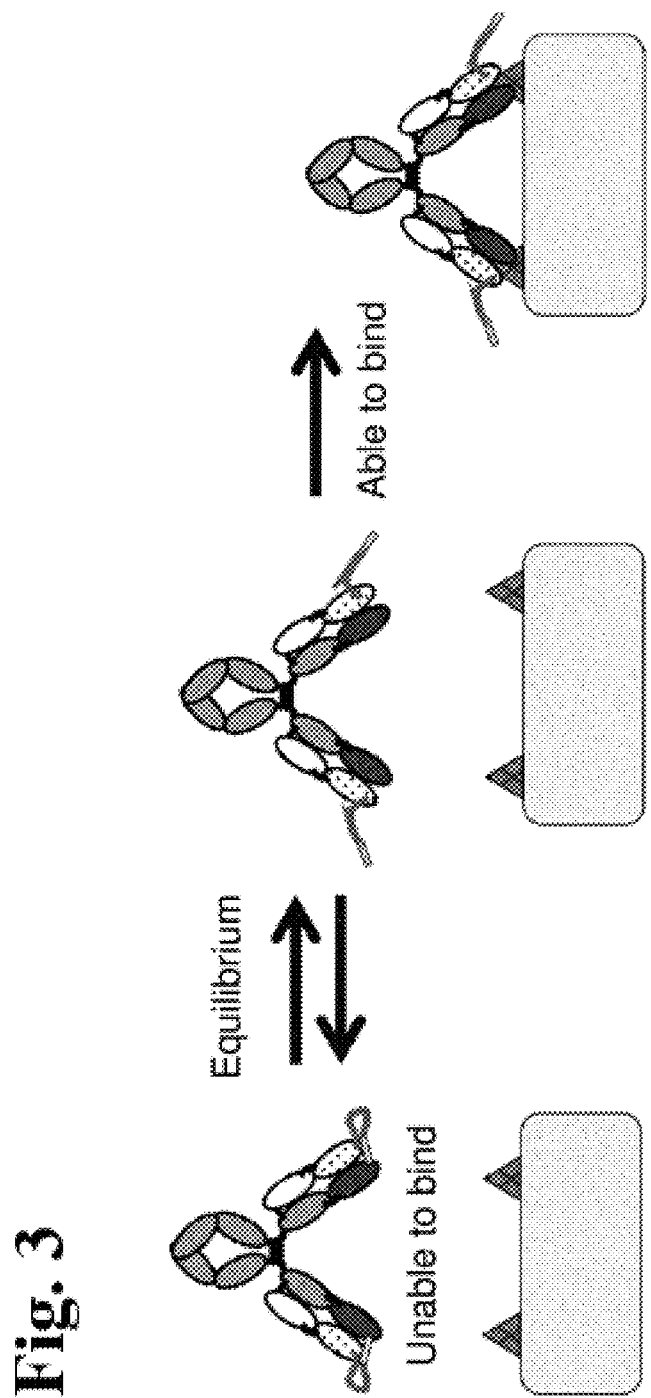

The antigen binding activity of the Probody is inhibited by a masking peptide linked to an antibody via a linker, but is not completely inhibited. The Probody is in equilibrium between a state where the masking peptide linked via the linker is bound with the antigen binding site and a state where the masking peptide is dissociated. A molecule in the dissociated state can bind to the antigen (FIG. 3). In actuality, anti-EGFR Probody described in NPL 17 has binding activity against EGFR even before protease cleavage of the linker. Although 30 to 100-fold rise in binding activity is seen by the protease cleavage of the linker, the Probody present at a high concentration before activation might exhibit adverse reactions by binding to the antigen expressed in normal tissues, because the Probody before activation has 1/30 to 1/100 of the binding activity of the activated Probody.

The Probody employs an artificial peptide for masking the antigen binding site of the antibody. The artificial peptide has a sequence absent in natural human proteins and might therefore has immunogenicity in humans. Such immunogenicity is known to decrease the effects of antibody drugs by inducing anti-drug antibodies (Blood. 2016 Mar. 31; 127 (13): 1633-41).

Figure 4:
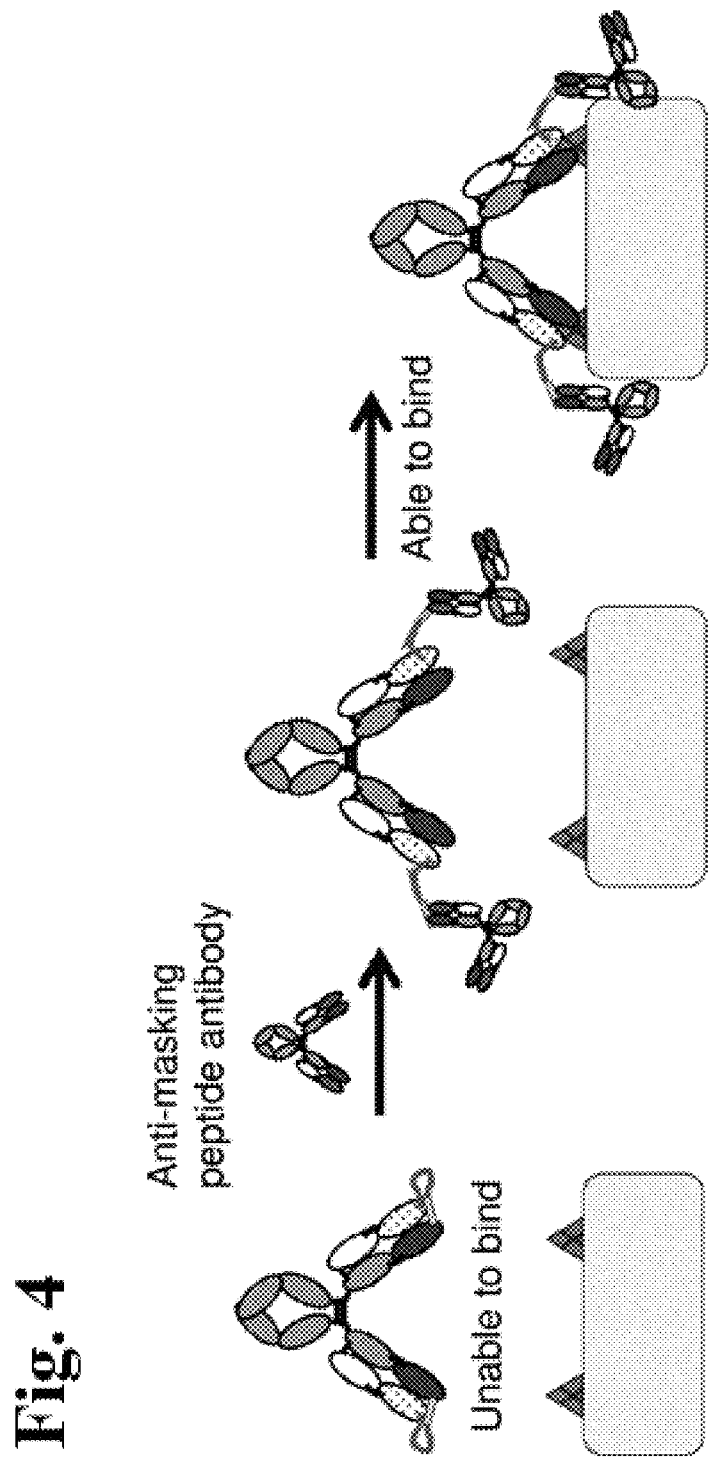

Possible anti-drug antibodies against Probody are an anti-drug antibody against a complex of the antibody and the masking peptide (Probody before activation), an anti-drug antibody against the antibody dissociated from the masking peptide (activated Probody), an anti-drug antibody against the masking peptide (masking peptide dissociated from the activated Probody), and the like. Among them, the anti-drug antibody against the masking peptide (anti-masking peptide antibody) might bind to the masking peptide of Probody before activation and thereby activate the Probody without protease cleavage (FIG. 4). The Probody activated by the anti-masking peptide antibody might exhibit adverse reactions by binding to the antigen expressed in normal tissues.

Example 2 Concept of Protease-Activated Polypeptide Comprising Single-Domain Antibody As shown in Example 1, the Probody technology presents the following problems:
1. Probody activated by protease cleavage has a long circulation time in blood.
2. Even Probody before protease cleavage has binding activity against the antigen.
3. The masking peptide is an artificial non-human sequence and may induce an anti-masking peptide antibody.

The present inventors thought that a useful way for solving these problems and providing an antibody drug exerting activity at a pathological site is to satisfy the following conditions:
1. An antigen binding domain activated by protease cleavage has a short half-life in blood.
2. The antigen binding activity of a molecule before protease cleavage is minimized.
3. The masking peptide having an artificial non-human sequence is not used.

Figure 5:
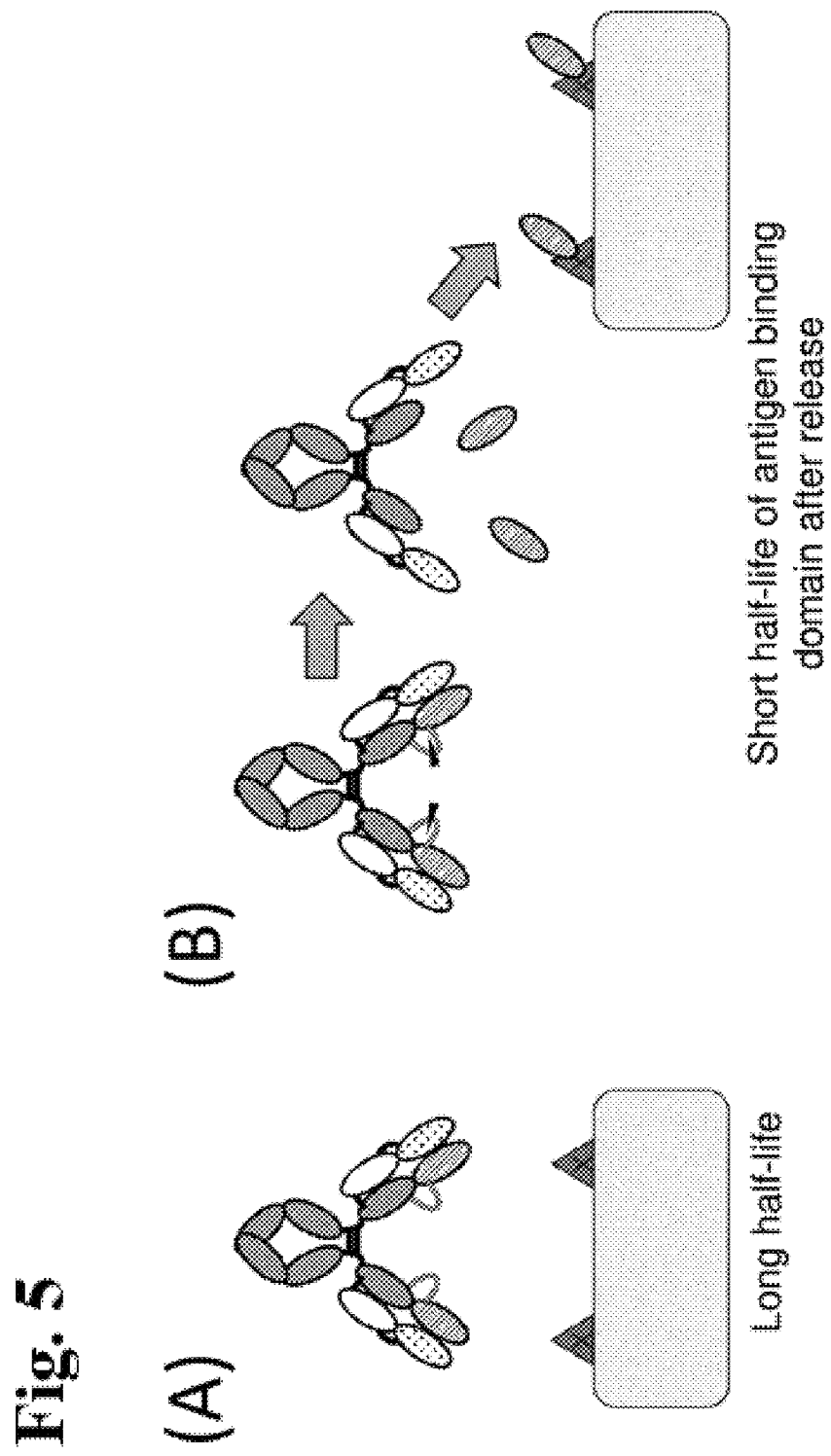

The present inventors devised a molecule shown in FIG. 5 as one example of a polypeptide that satisfied the conditions described above. The polypeptide with an antigen binding domain linked to a carrying moiety has a long half-life and does not bind to the antigen because the antigen binding activity of the antigen binding domain is inhibited (A). The antigen binding domain is released, and the antigen binding domain thus released restores its antigen binding activity and also has a short half-life (B).

Figure 6:
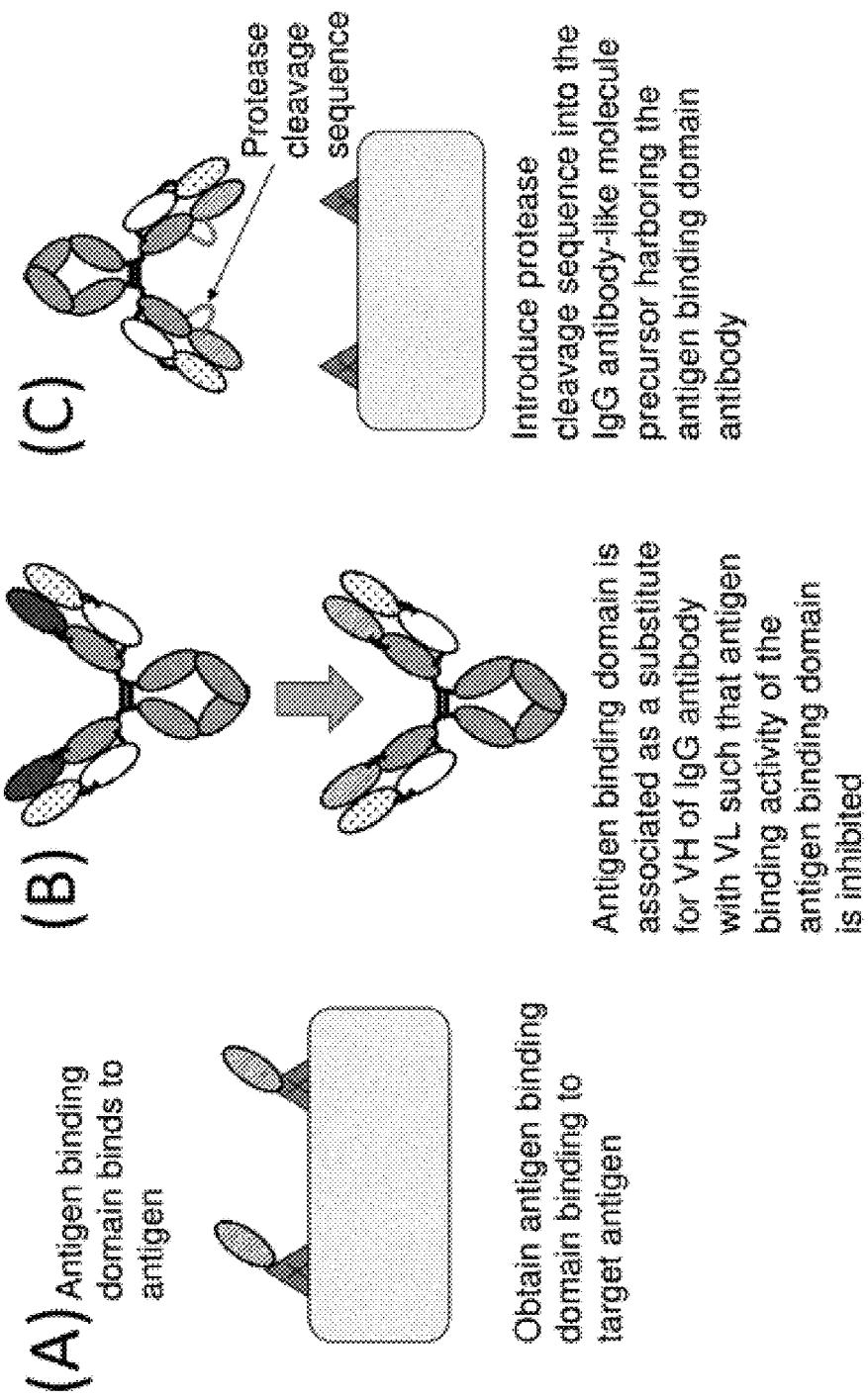

The polypeptide shown in FIG. 5 has various variations. In the case of using an IgG antibody-like molecule, the polypeptide may be produced by a production method as illustrated in FIG. 6. First, a single-domain antibody (e.g., VH or VHH) binding to the target antigen is obtained (A). The obtained single-domain antibody is associated, as a substitute for one of VH and VL of an IgG antibody having a germline sequence, with the other one (VL or VH) to form an IgG antibody-like molecule (B). A protease cleavage sequence is introduced into the IgG antibody-like molecule (C). Examples of the introduction position include a position near the boundary between the harbored single-domain antibody (VH or VHH) and the constant region (CH1 or CL).

The single-domain antibody has antigen binding activity when existing alone, but loses its antigen binding activity upon formation of a variable region with VL, VH, VHH, or the like. VL or VH is a natural human antibody sequence having a germline sequence and therefore has a low risk of immunogenicity and is unlikely to induce an anti-drug antibody recognizing this VL or VH. In the case of forming a variable region of the single-domain antibody with VHH, the humanization of the VHH reduces the risk of immunogenicity and reduces the likelihood of inducing an anti-drug antibody recognizing this humanized VHH. The protease cleavage sequence inserted into the IgG antibody-like molecule is cleaved by protease so that the single-domain antibody is released. The released single-domain antibody has antigen binding activity. The IgG antibody-like molecule before protease cleavage is structurally similar to general IgG molecules and therefore has a long circulation time in blood, whereas the single-domain antibody released by protease cleavage has a molecular weight of approximately 13 kDa without retaining a Fc region and therefore disappears rapidly by renal excretion. In actuality, the half-life of full-length IgG is on the order of 2 to 3 weeks (Blood. 2016 Mar. 31; 127 (13): 1633-41), whereas the half-life of the single-domain antibody is approximately 2 hours (Antibodies 2015, 4 (3), 141-156). Hence, the antigen binding molecule activated by protease has a short half-life in blood and becomes unlikely to bind to the antigen in normal tissues.

When the single-domain antibody is VL, the same concept as above may be achieved, for example, by introducing the protease cleavage sequence to near the boundary between VL and CL.

Example 3 Preparation of Protease-Activated Polypeptide Using VHH Binding to IL6R 3-1 Preparation of Polypeptide with Incorporated VHH Binding to IL6R An expression vector encoding IL6R90-G1m (SEQ ID NO: 2) containing IL6R90 (SEQ ID NO: 1), VHH having binding and neutralizing activities against human IL6R as described in International Publication No. WO2010/115998, fused with a human IgG1 constant region (CH1-hinge-CH2-CH3) was prepared by a method known to those skilled in the art.

Expression vectors encoding VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), VL3-21-1amL (SEQ ID NO: 9), k0 (SEQ ID NO: 10), and 1amL (SEQ ID NO: 11) as light chains (variable region-constant region) of various subclasses having a human germline sequence were prepared by a method known to those skilled in the art.

IgG antibody-like molecules IL6R90-G1m/VK1-39-k0MT (heavy chain: SEQ ID NO: 2, light chain: SEQ ID NO: 3), IL6R90-G1m/VK2-28-k0MT (heavy chain: SEQ ID NO: 2, light chain: SEQ ID NO: 4), IL6R90-G1m/VK3-20-k0MT (heavy chain: SEQ ID NO: 2, light chain: SEQ ID NO: 5), IL6R90-G1m/VL1-40-1amL (heavy chain: SEQ ID NO: 2, light chain: SEQ ID NO: 6), IL6R90-G1m/VL1-44-1amL (heavy chain: SEQ ID NO: 2, light chain: SEQ ID NO: 7), IL6R90-G1m/VL2-14-1amL (heavy chain: SEQ ID NO: 2, light chain: SEQ ID NO: 8), IL6R90-G1m/VL3-21-1amL (heavy chain: SEQ ID NO: 2, light chain: SEQ ID NO: 9), IL6R90-G1m/k0 (heavy chain: SEQ ID NO: 2, light chain: SEQ ID NO: 10), and IL6R90-G1m/1amL (heavy chain: SEQ ID NO: 2, light chain: SEQ ID NO: 11) were expressed by transient expression using FreeStyle 293 cells (Invitrogen Corp.) by a method known to those skilled in the art, and purified by a method known to those skilled in the art using protein A.

3-2 IL6R Binding Evaluation of Polypeptide with Incorporated VHH Binding to Human IL6R IL6R90-G1m/VK1-39-k0MT, IL6R90-G1m/VK2-28-k0MT, IL6R90-G1m/VK3-20-k0MT, IL6R90-G1m/VL1-40-1amL, IL6R90-G1m/VL1-44-1amL, IL6R90-G1m/VL2-14-1amL, IL6R90-G1m/VL3-21-1amL, IL6R90-G1m/k0, and IL6R90-G1m/1amL were evaluated for their binding activity against human IL6R by the following method.

Recombinant human IL6R used as an antigen was prepared as follows: a CHO line stably expressing soluble human IL-6R (hereinafter, also referred to as hsIL-6R, IL6R or IL-6R) consisting of an amino acid sequence from positions 1 to 357 counted from the N terminus as reported in J. Immunol. 152, 4958-4968 (1994) was constructed by a method known to those skilled in the art, cultured, and caused to express hsIL-6R. From the obtained culture supernatant, hsIL-6R was purified by 2 steps of Blue Sepharose 6 FF column chromatography and gel filtration column chromatography. A fraction eluted as a main peak in the final step was used as a final purified product.

Figure 10:
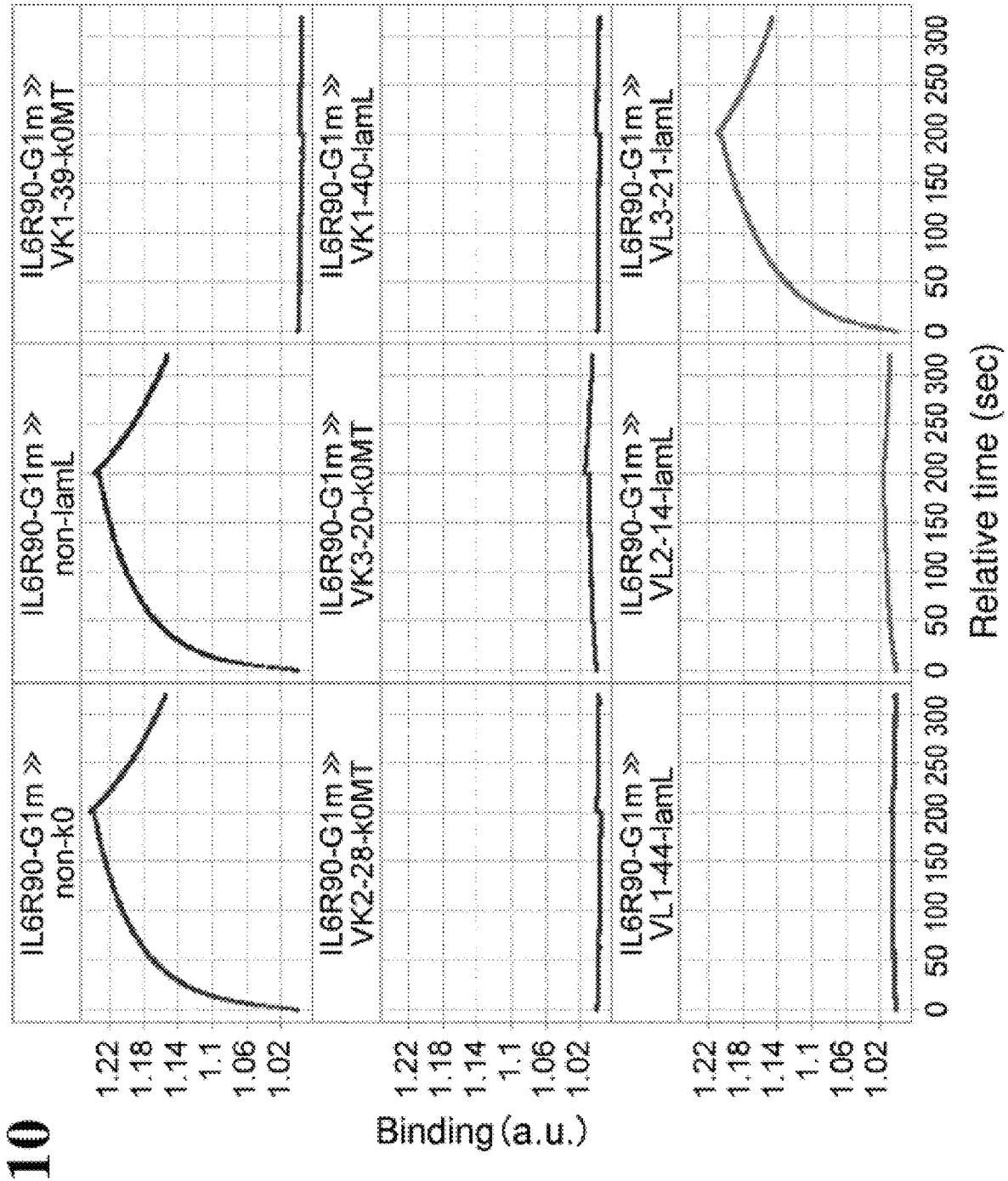
Figures 1, 12:
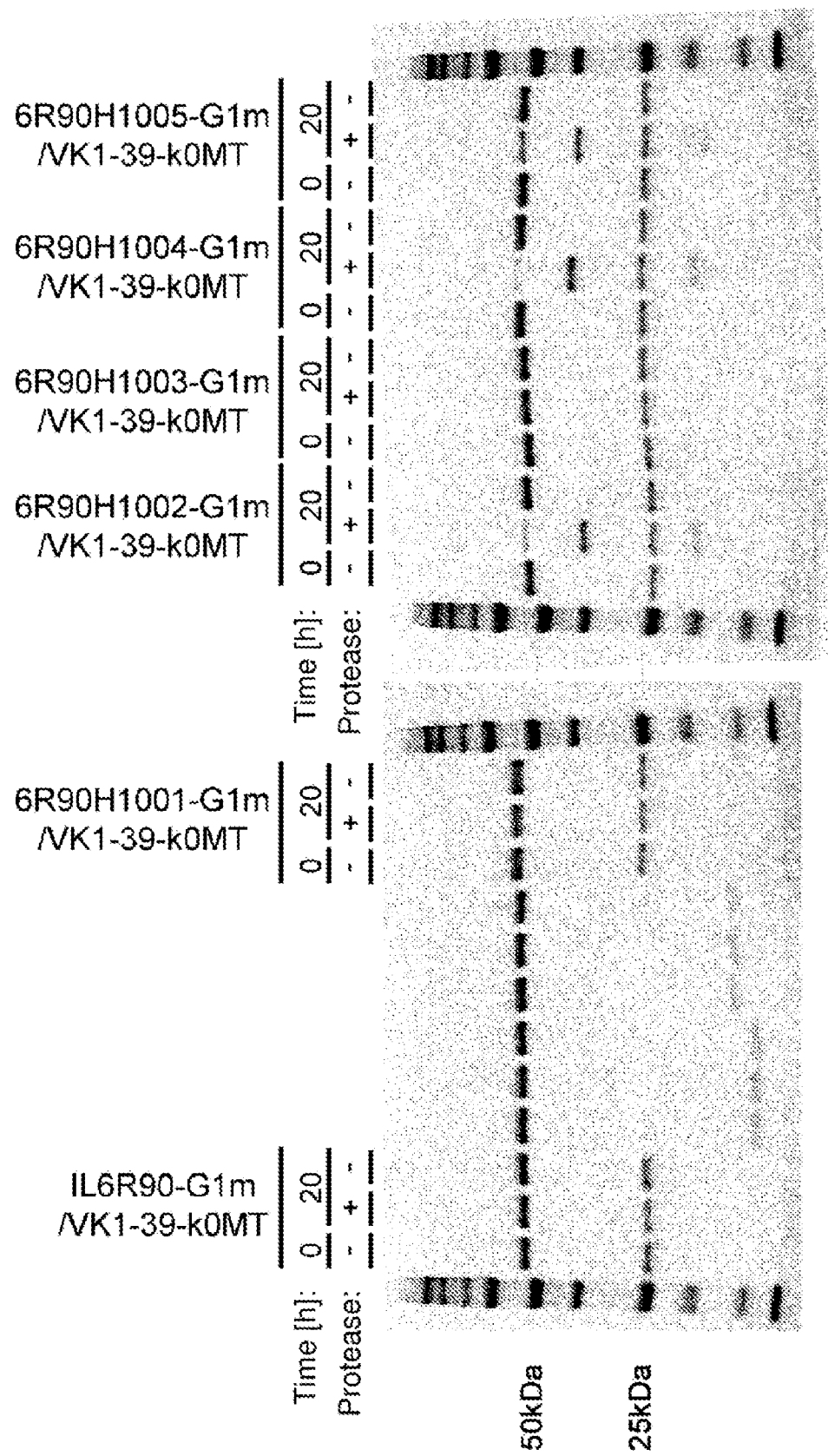
Figures 2, 12:
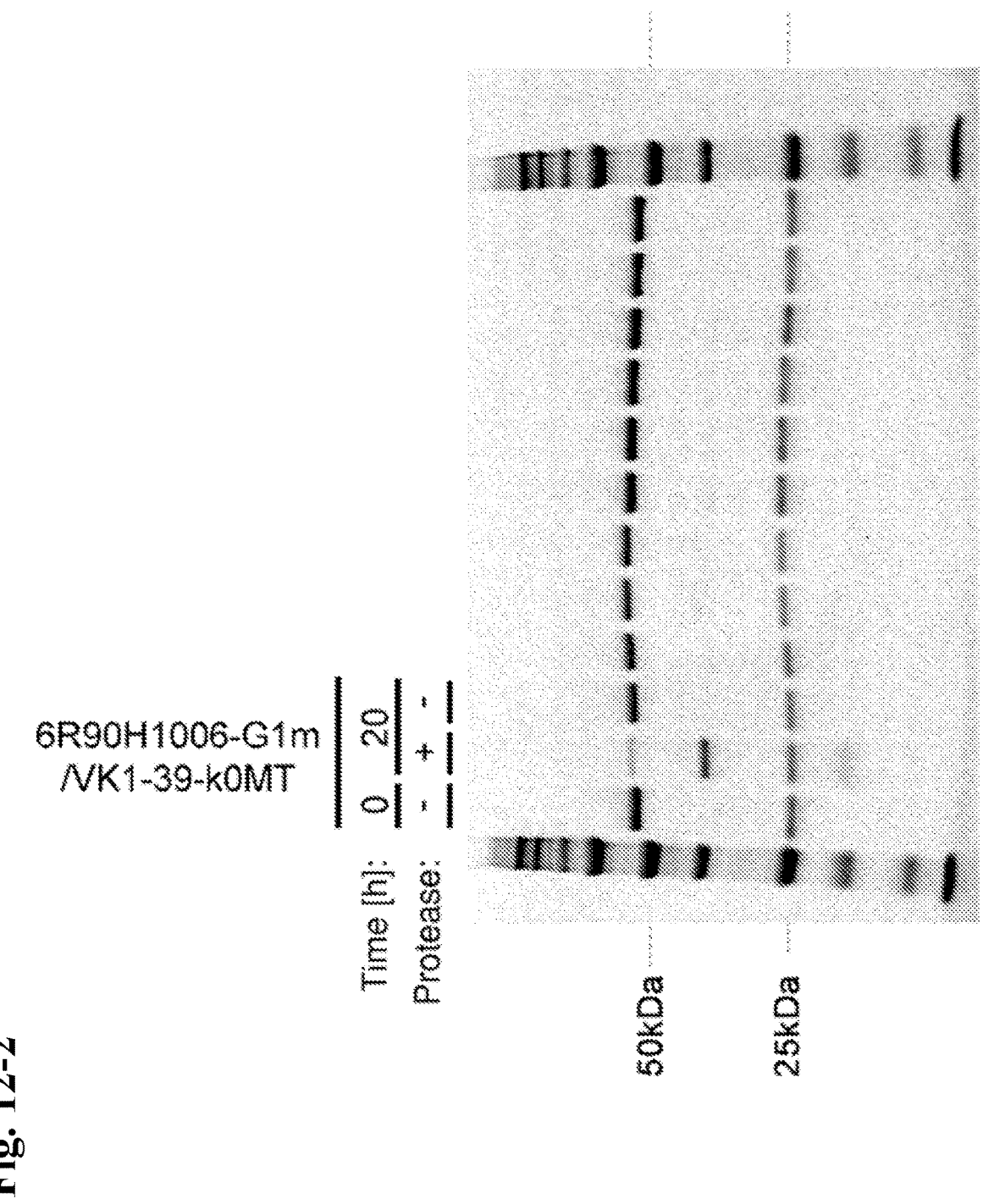

The hsIL-6R binding evaluation of each molecule was conducted using Octet HTX (Pall ForteBio Corp.). Specifically, each molecule was bound to Biosensor/Protein A (ProA) (Pall ForteBio Corp., 18-5013), and hsIL-6R was allowed to act thereon, followed by binding evaluation at 30 degrees C. Sensorgrams showing continuous responses measured using Octet HTX are shown in FIG. 10. IL6R90-G1m/k0 and IL6R90-G1m/1amL lacking VL bound to hsIL-6R, whereas IL6R90-G1m/VK1-39-k0MT, IL6R90-G1m/VK2-28-k0MT, IL6R90-G1m/VK3-20-k0MT, IL6R90-G1m/VL1-40-1amL, IL6R90-G1m/VL1-44-1amL, and IL6R90-G1m/VL2-14-1amL containing a variable region formed with VL were shown to be unable to bind to hsIL-6R. From this, it was found that VHH having binding activity against human IL6R can lose its IL6R binding activity by forming a variable region through association with VL.

3-3 Introduction of Protease Cleavage Sequence to Polypeptide with Incorporated VHH Binding to IL6R A protease cleavage sequence was inserted to near the boundary between the anti-human IL6R VHH IL6R90 and CH1. Six types of heavy chains shown in FIG. 11 were designed such that peptide sequence A (SEQ ID NO: 12), a reported sequence cleavable by cancer-specifically expressed urokinase (uPA) and MT-SP1, was inserted at 3 sites near the boundary between IL6R90 and CH1 with or without a glycine-serine linker. Expression vectors encoding IL6R90H1001 (SEQ ID NO: 13), IL6R90H1002 (SEQ ID NO: 14), IL6R90H1003 (SEQ ID NO: 15), IL6R90H1004 (SEQ ID NO: 16), IL6R90H1005 (SEQ ID NO: 17), and IL6R90H1006 (SEQ ID NO: 18) were prepared by a method known to those skilled in the art.

IgG antibody-like molecules IL6R90H1001/VK1-39-k0MT (heavy chain: SEQ ID NO: 13, light chain: SEQ ID NO: 3), IL6R90H1002/VK1-39-k0MT (heavy chain: SEQ ID NO: 14, light chain: SEQ ID NO: 3), IL6R90H1003/VK1-39-k0MT (heavy chain: SEQ ID NO: 15, light chain: SEQ ID NO: 3), IL6R90H1004/VK1-39-k0MT (heavy chain: SEQ ID NO: 16, light chain: SEQ ID NO: 3), IL6R90H1005/VK1-39-k0MT (heavy chain: SEQ ID NO: 17, light chain: SEQ ID NO: 3), and IL6R90H1006/VK1-39-k0MT (heavy chain: SEQ ID NO: 18, light chain: SEQ ID NO: 3) were expressed by transient expression using these heavy chains and VK1-39-k0MT (SEQ ID NO: 3) as light chain and using FreeStyle 293 cells (Invitrogen Corp.) by a method known to those skilled in the art, and purified by a method known to those skilled in the art using protein A.

3-4 Activation of Polypeptide Harboring Protease Cleavage Sequence by Protease Cleavage Whether IL6R90H1001/VK1-39-k0MT, IL6R90H1002/VK1-39-k0MT, IL6R90H1003/VK1-39-k0MT, IL6R90H1004/VK1-39-k0MT, IL6R90H1005/VK1-39-k0MT, and IL6R90H1006/VK1-39-k0MT would release VHH having binding activity against IL6R by protease cleavage was verified.

Soluble human IL6R was prepared by a method known to those skilled in the art. The prepared soluble human IL6R was biotinylated by a method known to those skilled in the art.

For the purpose of attaching biotin to the C terminus of soluble human IL-6R (also referred to as hsIL-6R or soluble human IL6R; SEQ ID NO: 35), a gene fragment encoding a specific sequence (AviTag sequence; SEQ ID NO: 36) to be biotinylated by biotin ligase was linked via a gene fragment encoding a linker to downstream of a gene fragment encoding hsIL-6R. A gene fragment encoding a protein containing hsIL-6R linked to the AviTag sequence (hsIL-6R-Avitag; SEQ ID NO: 37) was integrated to a vector for expression in animal cells. The constructed plasmid vector was transfected to FreeStyle 293 cells (Invitrogen Corp.) using 293Fectin (Invitrogen Corp.). In this operation, the cells were cotransfected with a gene for EBNA1 (SEQ ID NO: 57) expression and a gene for biotin ligase (BirA; SEQ ID NO: 58) expression, and biotin was further added thereto for the purpose of biotin-labeling hsIL-6R-Avitag. The cells transfected according to the procedures mentioned above were cultured at 37 degrees C. under 8% $CO_2$ and the protein of interest (hsIL-6R-BAP1) was secreted into the culture supernatant. This cell culture solution was filtered through a 0.22 micro m bottle-top filter to obtain a culture supernatant.

An anti-human IL-6R antibody was immobilized on HiTrap NHS-activated HP (GE Healthcare Japan Corp.) according to the protocol of the manufacturer to prepare a column (anti-human IL-6R antibody column). The culture supernatant was applied to the anti-human IL-6R antibody column equilibrated with TBS, followed by the elution of the bound hsIL-6R with 2 M arginine (pH 4.0). Next, the eluate from the anti-human IL-6R antibody column was diluted with TBS and then applied to SoftLink Avidin column (Promega Corp.) equilibrated with TBS, followed by the elution of hsIL-6R-BAP1 with 5 mM biotin, 50 mM Tris-HCl (pH 8.0) and 2 M arginine (pH 4.0). From this eluate, aggregates of hsIL-6R-BAP1 were removed by gel filtration chromatography using Superdex 200 (GE Healthcare Japan Corp.) to obtain purified hsIL-6R-BAP1 with the buffer exchanged with D-PBS and 0.05% CHAPS.

Recombinant Human Matriptase/ST14 Catalytic Domain (R&D Systems, Inc., 3946-SE-010) was used as the protease. 12.5 nM protease and 100 micro g/mL of each IgG antibody-like molecule were incubated in PBS under a condition of 37 degrees C. for 20 hours. Then, cleavage by the protease was evaluated by reducing SDS-PAGE. The results are shown in FIG. 12. As a result, the protease cleavage of the protease cleavage sequence near the boundary between the VHH and the heavy chain constant region was confirmed in IL6R90H1002/VK1-39-k0MT, IL6R90H1004/VK1-39-k0MT, IL6R90H1005/VK1-39-k0MT, and IL6R90H1006/VK1-39-k0MT.

Figure 13:
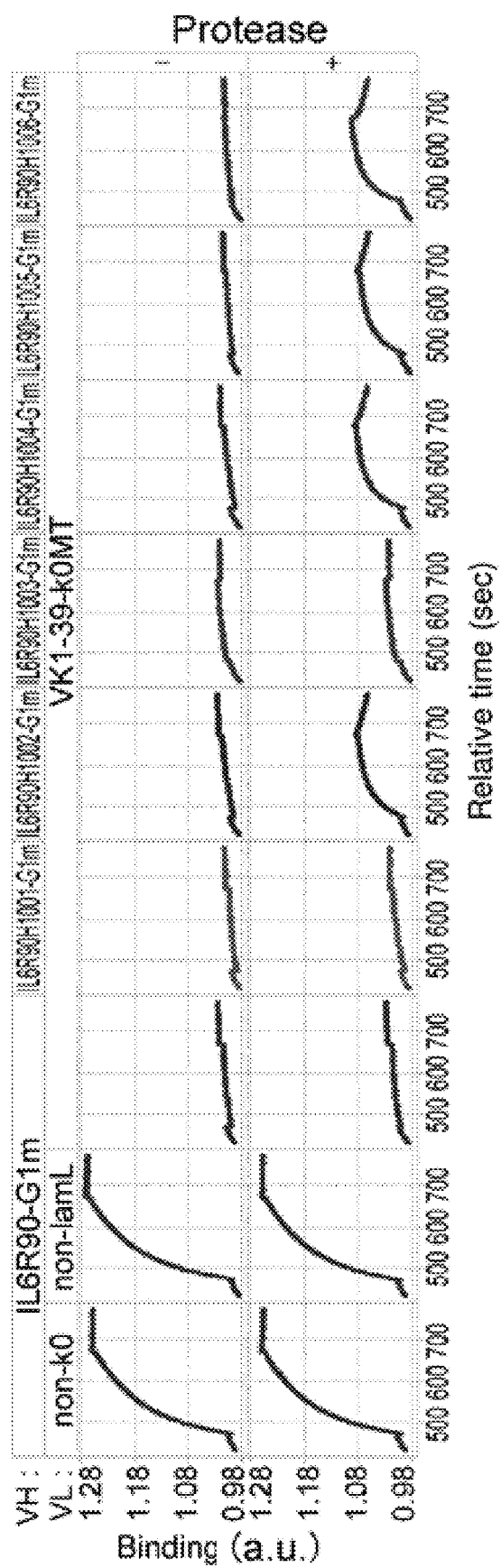

Next, the IL6R binding evaluation of VHH released by protease treatment was conducted using Octet HTX (Pall ForteBio Corp.). Specifically, hsIL-6R-BAP1 was bound to a streptavidin sensor (Pall ForteBio Corp., 18-5021), and each cleaved IgG antibody-like molecule was allowed to act thereon, followed by binding evaluation at 30 degrees C. Sensorgrams showing continuous responses measured using Octet HTX are shown in FIG. 13. As a result, the binding was confirmed in IL6R90H1002/VK1-39-k0MT, IL6R90H1004/VK1-39-k0MT, IL6R90H1005/VK1-39-k0MT, and IL6R90H1006/VK1-39-k0MT. IL6R90-G1m/k0 and IL6R90-G1m/1amL divalently bound with avidity, whereas the released VHH bound with affinity. Therefore, the protease-treated IL6R90H1002/VK1-39-k0MT, IL6R90H1004/VK1-39-k0MT, IL6R90H1005/VK1-39-k0MT, and IL6R90H1006/VK1-39-k0MT exhibited a faster dissociation rate from IL6R than that of IL6R90-G1m/k0 and IL6R90-G1m/1amL. Also, the VHH had a smaller molecular weight than that of IL6R90-G1m/k0 and IL6R90-G1m/1amL. Therefore, its response was lower.

These results demonstrated that IL6R90H1002/VK1-39-k0MT, IL6R90H1004/VK1-39-k0MT, IL6R90H1005/VK1-39-k0MT, or IL6R90H1006/VK1-39-k0MT does not exhibit binding activity against IL6R as is, whereas the peptide sequence A inserted near the boundary between the VHH and the heavy chain constant region is cleaved by protease treatment so that the VHH domain is released, and the released VHH can bind to IL6R. From this, it was concluded that the molecule conforming to the concept described in Example 2 was actually able to be prepared.

Example 4 Preparation of Protease-Activated Polypeptide by Alteration Using VHH Binding to IL6R 4-1 IL6R Binding Evaluation of Polypeptide with Incorporated VHH Binding to IL6R An expression vector encoding 20A11-G1m (SEQ ID NO: 38) containing 20A11 (SEQ ID NO: 19), VHH having binding and neutralizing activities against IL6R as described in International Publication No. WO2010/115998, fused with a human IgG1 constant region (CH1-hinge-CH2-CH3) in the same way as in Example 3 was prepared by a method known to those skilled in the art.

Polypeptides 20A11-G1m/VK1-39-k0MT, 20A11-G1m/VK2-28-k0MT, 20A11-G1m/VK3-20-k0MT, 20A11-G1m/VL1-40-1amL, 20A11-G1m/VL1-44-1amL, 20A11-G1m/VL2-14-1amL, and 20A11-G1m/VL3-21-1amL were expressed and purified in the same way as in Example 3 using this heavy chain and VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), and VL3-21-1amL (SEQ ID NO: 9) as light chains.

Figure 14:
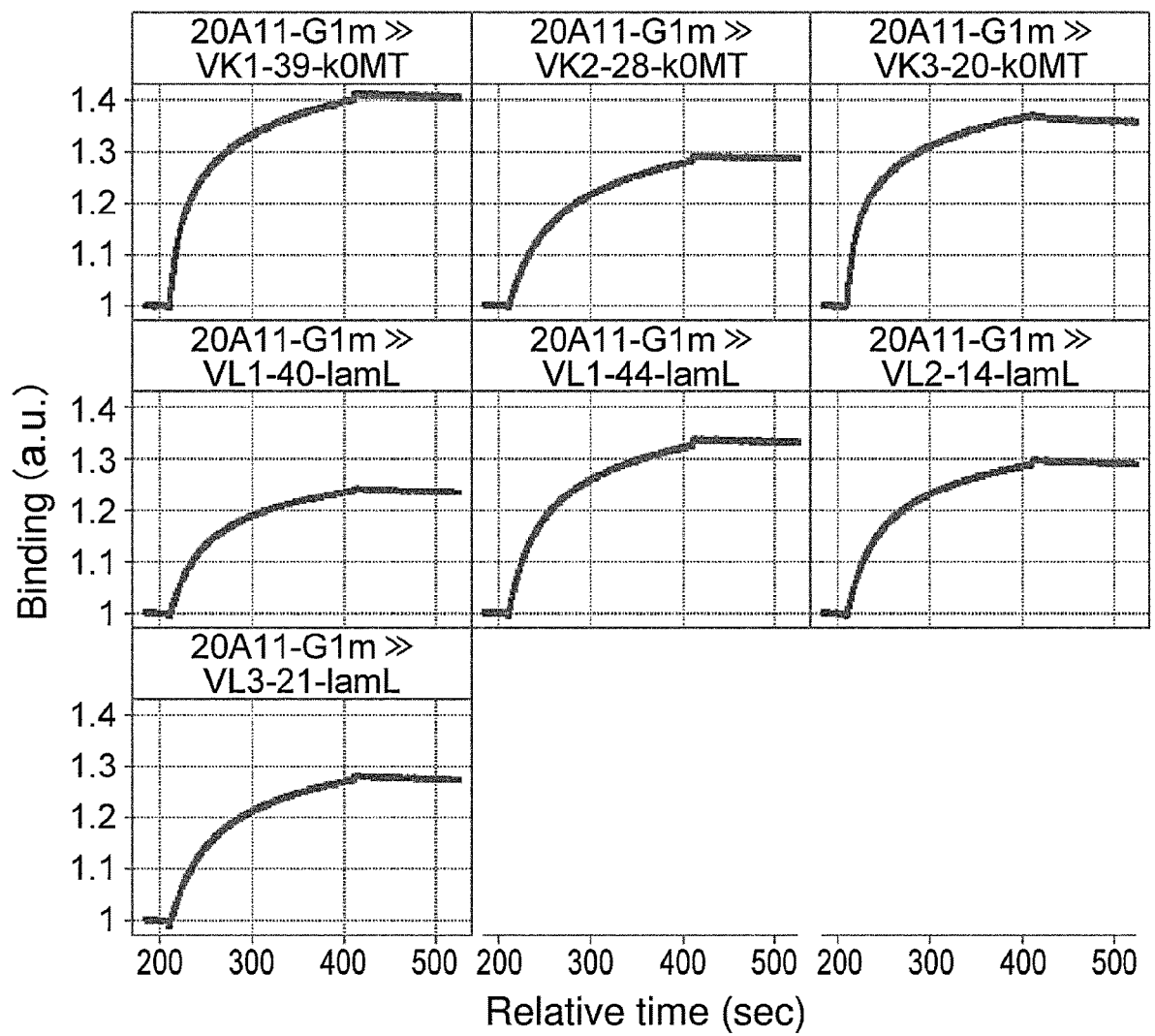

The obtained 20A11-G1m/VK1-39-k0MT (heavy chain: SEQ ID NO: 38, light chain: SEQ ID NO: 3), 20A11-G1m/VK2-28-k0MT (heavy chain: SEQ ID NO: 38, light chain: SEQ ID NO: 4), 20A11-G1m/VK3-20-k0MT (heavy chain: SEQ ID NO: 38, light chain: SEQ ID NO: 5), 20A11-G1m/VL1-40-1amL (heavy chain: SEQ ID NO: 38, light chain: SEQ ID NO: 6), 20A11-G1m/VL1-44-1amL (heavy chain: SEQ ID NO: 38, light chain: SEQ ID NO: 7), 20A11-G1m/VL2-14-1amL (heavy chain: SEQ ID NO: 38, light chain: SEQ ID NO: 8), and 20A11-G1m/VL3-21-1amL (heavy chain: SEQ ID NO: 38, light chain: SEQ ID NO: 9) were evaluated for their binding to IL6R in the same way as in Example 3. The results are shown in FIG. 14. As a result, none of the light chains used in this Example inhibited the IL6R binding activity of 20A11 by associating with the heavy chain containing the 20A11 fused with the human germline IgG1 constant region (CH1-hinge-CH2-CH3).

This is probably because 20A11 did not form a stable variable region with VL used in this Example.

4-2 Introduction of Amino Acid Alteration to Interface Site Between VHH and VL in Polypeptide with Incorporated VHH not Losing Antigen Binding In order to form a stable variable region between 20A11 and VL, mutations were introduced to amino acids present at the interface between the 20A11 and the VL. An expression vector encoding 20A11hu-G1m (SEQ ID NO: 39) containing 20A11hu (derived from 20A11 by the introduction of mutations to substitute F at position 37 by V (F37V), R at position 45 by L, and G at position 47 by W (all according to the Kabat numbering)) (SEQ ID NO: 20) fused with a human IgG1 constant region (CH1-hinge-CH2-CH3) in the same way as in Example 3 was prepared by a method known to those skilled in the art.

Polypeptides 20A11hu-G1m/VK1-39-k0MT (heavy chain: SEQ ID NO: 39, light chain: SEQ ID NO: 3), 20A11hu-G1m/VK2-28-k0MT (heavy chain: SEQ ID NO: 39, light chain: SEQ ID NO: 4), 20A11hu-G1m/VK3-20-k0MT (heavy chain: SEQ ID NO: 39, light chain: SEQ ID NO: 5), 20A11hu-G1m/VL1-40-1amL (heavy chain: SEQ ID NO: 39, light chain: SEQ ID NO: 6), 20A11hu-G1m/VL1-44-1amL (heavy chain: SEQ ID NO: 39, light chain: SEQ ID NO: 7), 20A11hu-G1m/VL2-14-1amL (heavy chain: SEQ ID NO: 39, light chain: SEQ ID NO: 8), and 20A11hu-G1m/VL3-21-1amL (heavy chain: SEQ ID NO: 39, light chain: SEQ ID NO: 9) were expressed and purified in the same way as in Example 3 using this heavy chain and VK1-39-k0MT (SEQ ID NO: 3), VK2-28-k0MT (SEQ ID NO: 4), VK3-20-k0MT (SEQ ID NO: 5), VL1-40-1amL (SEQ ID NO: 6), VL1-44-1amL (SEQ ID NO: 7), VL2-14-1amL (SEQ ID NO: 8), and VL3-21-1amL (SEQ ID NO: 9) as light chains.

Figure 15:
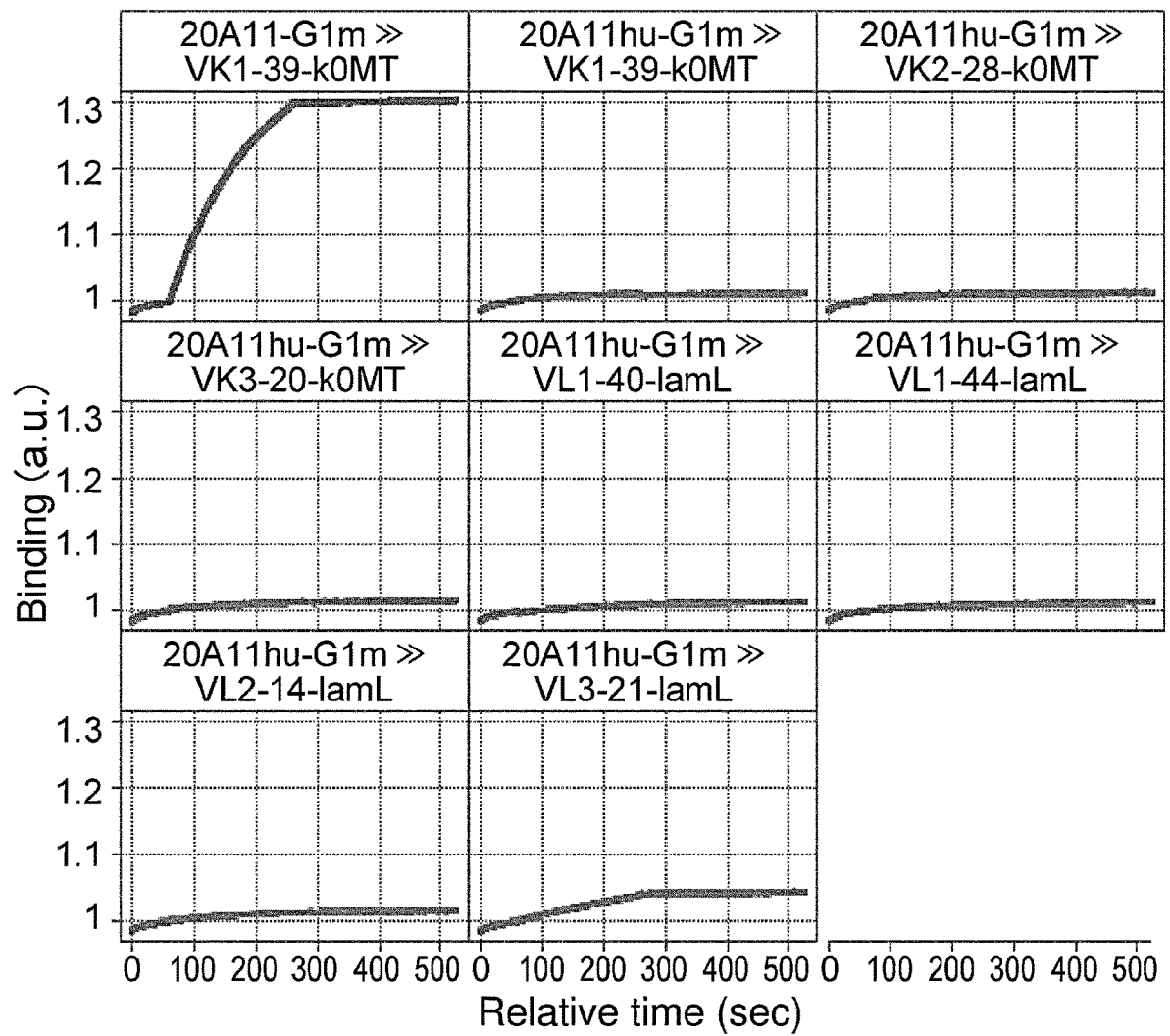

4-3 IL6R Binding Evaluation of Polypeptide with Incorporated VHH Containing Amino Acid Alteration at Interface Site Between the VHH and VL The obtained 20A11hu-G1m/VK1-39-k0MT, 20A11hu-G1m/VK2-28-k0MT, 20A11hu-G1m/VK3-20-k0MT, 20A11hu-G1m/VL1-40-1amL, 20A11hu-G1m/VL1-44-1amL, 20A11hu-G1m/VL2-14-1amL, and 20A11hu-G1m/VL3-21-1amL were evaluated for their binding to IL6R at 30 degrees C. or 25 degrees C. in the same way as in Example 3. The results are shown in FIG. 15.

As a result, 20A11hu-G1m/VK1-39-k0MT, 20A11hu-G1m/VK2-28-k0MT, 20A11hu-G1m/VK3-20-k0MT, 20A11hu-G1m/VL1-40-1amL, 20A11hu-G1m/VL1-44-1amL, and 20A11hu-G1m/VL2-14-1amL were shown to be unable to bind to IL6R.

These results demonstrated that the VHH 20A11, which did not lose its IL6R binding activity by associating with VL, used in Example 3, can form a stable variable region with VL and can lose its IL6R binding activity, by converting amino acids present at the interface site between the VHH and the VL to 37V, 45L, and 47W (Kabat numbering) and thereby altering the 20A11 to 20A11hu.

4-4 Introduction of Protease Cleavage Sequence to Polypeptide with Incorporated VHH Containing Amino Acid Alteration at Interface Site Between the VHH and VL Heavy chains 20A11huH1001 (SEQ ID NO: 40), 20A11huH1002 (SEQ ID NO: 41), 20A11huH1004 (SEQ ID NO: 42), and 20A11huH1006 (SEQ ID NO: 43) were prepared in the same way as in Example 3 such that a protease cleavage sequence (SEQ ID NO: 12) or a protease cleavage sequence linked to a flexible linker (SEQ ID NO: 44) was inserted near the boundary between 20A11hu and CH1.

Polypeptides 20A11huH1001/VK1-39-k0MT (heavy chain: SEQ ID NO: 40, light chain: SEQ ID NO: 3), 20A11huH1 002/VK1-39-k0MT (heavy chain: SEQ ID NO: 41, light chain: SEQ ID NO: 3), 20A11huH1004/VK1-39-k0MT (heavy chain: SEQ ID NO: 42, light chain: SEQ ID NO: 3), and 20A11huH1006/VK1-39-k0MT (heavy chain: SEQ ID NO: 43, light chain: SEQ ID NO: 3) were expressed and purified in the same way as in Example 3 using these heavy chains and VK1-39-k0MT (SEQ ID NO: 3) as a light chain.

Figure 16:
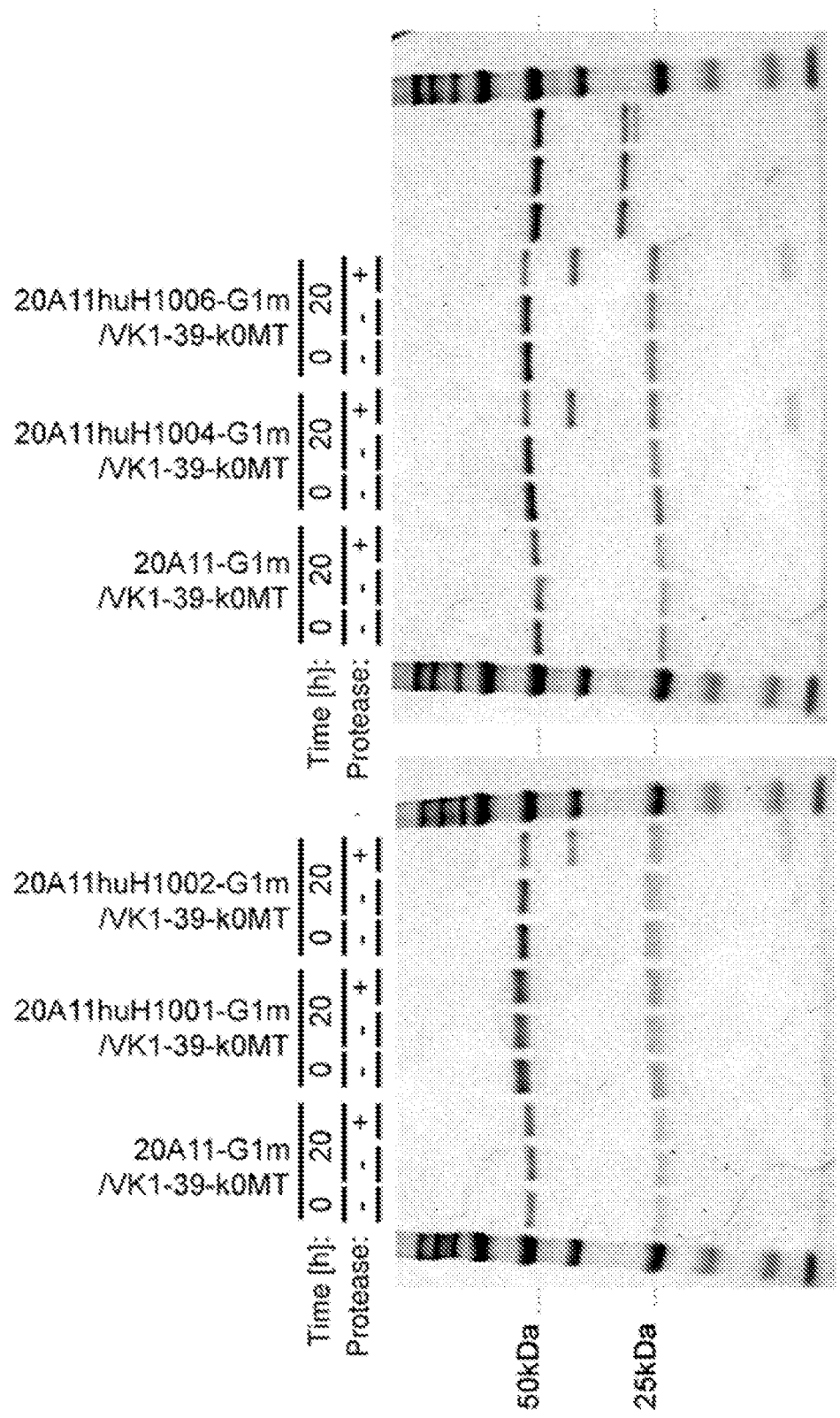

4-5 Activation of Polypeptide Harboring Protease Cleavage Sequence by Protease Cleavage 20A11huH1001/VK1-39-k0MT, 20A11huH1002/VK1-39-k0MT, 20A11huH1004/VK1-39-k0MT, and 20A11huH1006/VK1-39-k0MT were cleaved by protease in the same way as in Example 3, and the degree of the cleavage was evaluated by reducing SDS-PAGE. The results are shown in FIG. 16.

As a result, 20A11huH1002/VK1-39-k0MT, 20A11huH1004/VK1-39-k0MT, and 20A11huH1006/VK1-39-k0MT were confirmed to undergo protease cleavage near the boundary between VHH and CH1.

Figure 17:
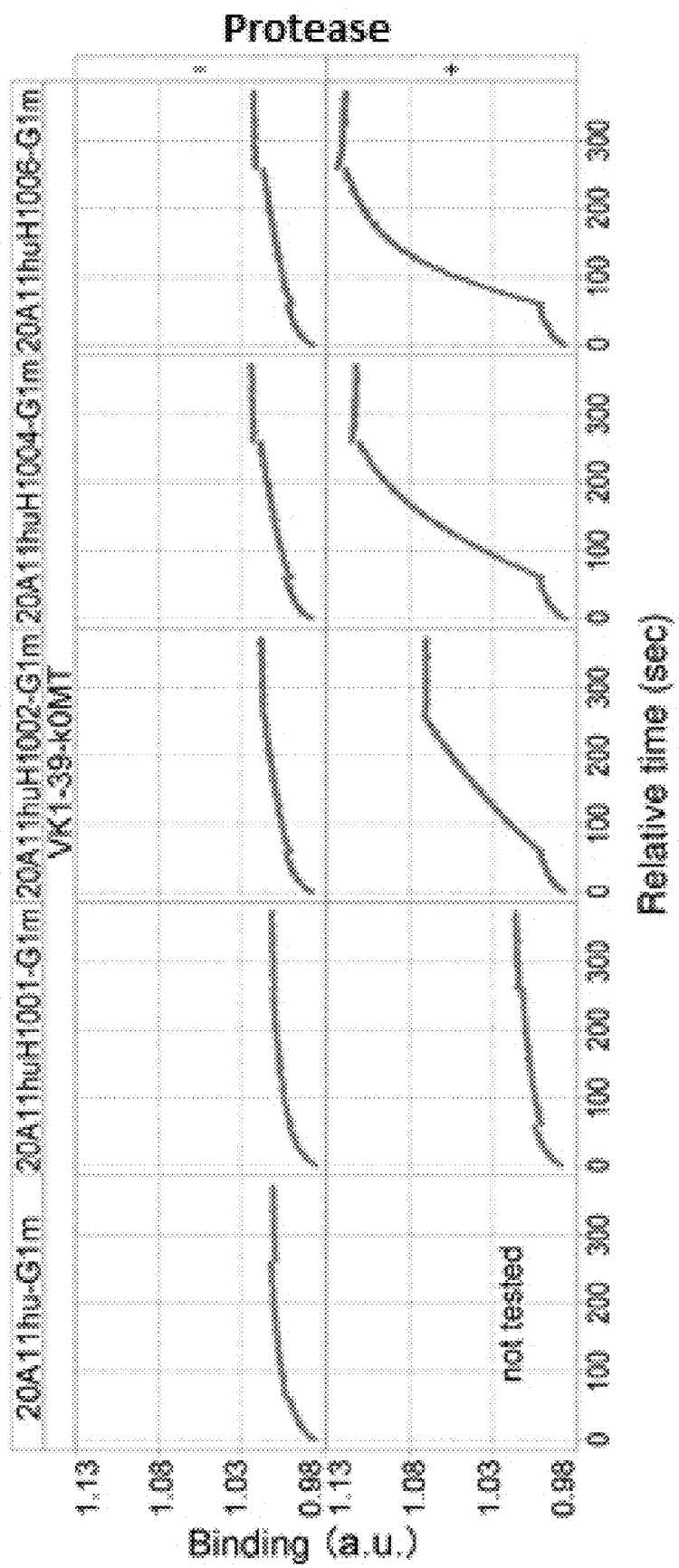

Next, the IL6R binding evaluation of VHH released by protease treatment was conducted at 30 degrees C. or 25 degrees C. in the same way as in Example 3. Octet sensorgrams are shown in FIG. 17.

As a result, the IL6R binding was confirmed in 20A11huH1002/VK1-39-k0MT, 20A11huH1004/VK1-39-k0MT, and 20A11huH1006/VK1-39-k0MT confirmed to undergo cleavage near the boundary between VHH and CH1 by protease treatment.

These results demonstrated that even if VHH incorporated in a polypeptide does not lose its antigen binding activity immediately after association with particular VL, the antigen binding activity can be lost by introducing an association promoting mutation to an amino acid present at the interface between the VHH and the VL.

From these results, it was concluded that the molecule conforming to the concept described in Example 2 can also be prepared by a method of combining a light chain with VHH containing a substituted amino acid involved in association with the light chain, in addition to the method of combining a light chain with VHH obtained in advance as in Example 3.

Example 5 Preparation of Protease-Activated Polypeptide Using VHH Derived from Immunized Alpaca 5-1 Obtainment of VHH Derived from Immunized Alpaca Alpacas were immunized with IL6R, CD3 or plexin A1 by a method known to those skilled in the art. 4 and 8 weeks later, PBMC was corrected. From the corrected PBMC, VHH gene was amplified with reference to a method described in J. Immunol. Methods (2007) 324, 13. The amplified VHH gene fragment was connected with gene 3 gene and inserted into a phagemid vector. The phagemid vector having the insert of the VHH fragment was transferred to *E. coli* by the electroporation method, and phages displaying g VHH were obtained by a method already known to those skilled in the art. The obtained phages were evaluated for their binding to IL6R, CD3 or plexin A1 by ELISA. The sequence of a bound clone was analyzed by a method known to those skilled in the art to identify VHH binding to the antigen.

5-2 Enrichment of VHH Binding to CD3

VHH binding to human CD3 was identified from the VHH library constructed in Example 5-1. VHH clones having binding capacity against human CD3 were enriched using a biotin-labeled protein containing human CD3 epsilon and human CD3 delta linked to a human antibody constant region (human CD3ed-Fc) as an antigen. The human CD3ed-Fc was prepared as follows: an expression vector for animal cells having a gene encoding the amino acid sequence represented by SEQ ID NO: 59, a gene encoding the amino acid sequence represented by SEQ ID NO: 60 and a gene encoding BirA (SEQ ID NO: 58) was transferred to FreeStyle 293 cells (Invitrogen Corp.). After the transfer, L-biotin was added thereto, and biotinylation was carried out in a culture solution. Cell culture was performed by shake culture at 37 degrees C. according to the protocol. 4 to 5 days later, the supernatant was recovered. From the supernatant, a protein fused with the antibody constant region was obtained using a protein A column (Eshmuno A (Merck KGaA)). For the purpose of further obtaining only a CD3 epsilon delta heterodimer, a fraction of the CD3 epsilon delta heterodimer fused with the antibody constant region (referred to as human CD3ed-Fc) was separated using Anti-FLAG M2 column. Subsequently, gel filtration chromatography (Superdex 200, GE Healthcare Japan Corp.) was carried out to obtain the fraction of the CD3 epsilon delta heterodimer of interest (referred to as human CD3ed-Fc).

Phage production was performed from *E. coli* retaining the constructed phagemids for phage display. A phage population was precipitated by the addition of 2.5 M NaCl/10% PEG to the culture solution of the *E. coli* after the phage production, and then diluted with TBS to obtain a phage library solution. Next, BSA was added to the phage library solution so as to attain a final BSA concentration of 4%. Panning was performed with reference to a general panning method using an antigen immobilized on magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (FG beads NeutrAvidin) or Streptavidin coated beads (Dynabeads MyOne Streptavidin T1).

Specifically, 100 pmol of the biotin-labeled antigen was added to the prepared phage library solution, and the phage library solution was contacted with the antigen at room temperature for 60 minutes. The magnetic beads blocked with BSA were added thereto, and the complexes of the antigen and the phages were bound to the magnetic beads at room temperature for 15 minutes. The beads were washed twice with 0.5 mL of TBST (TBS containing 0.1% Tween 20; TBS was manufactured by Takara Bio Inc.) and then further washed once with 0.5 mL of TBS. Then, 0.5 mL of 1 mg/mL trypsin was added thereto, and the beads were suspended at room temperature for 15 minutes and immediately thereafter, separated using a magnetic stand to recover a phage solution. The recovered phage solution was added to 20 mL of an *E. coli* line ER2738 in an exponential stage of growth (OD600: 0.4-0.5). The *E. coli* was cultured with mild stirring at 37 degrees C. for 1 hour and thereby infected by the phages. The infected *E. coli* was inoculated to a 225 mm×225 mm plate. Next, the phages were recovered from the culture supernatant of the inoculated *E. coli* to prepare a phage library solution. This cycle, called panning, was repeated a total of twice. In the second cycle of panning, the beads were washed three times with TBST and subsequently twice with TBS. Also, 4 nmol of human Fc was added when the human CD3ed-Fc contacted with phages.

5-3 Preparation of Protease-Activated IgG Antibody-Like Molecule with Incorporated VHH Binding to CD3

A nucleotide sequence encoding the VHH sequence (Table 1) of each binding clone for human CD3 obtained in Example 5-1 or 5-2 was connected to a nucleotide sequence encoding a protease cleavage site and a constant region by the method described in Example 3 and inserted into an expression vector for animal cells. The resultant was used as the heavy chain of an IgG antibody-like molecule.

TABLE 1

| VHH binding to human CD3 | |
|---|---|
| VHH | SEQ ID NO |
| bC3edL1R1N160H01 | 61 |
| bC3edL1R1N161H01 | 62 |
| bC3edL1R1N164H01 | 63 |

Protease-activated IgG antibody-like molecules shown in Table 2 below were expressed by transient expression using FreeStyle 293 cells (Invitrogen Corp.) by a method known to those skilled in the art, and purified by a method known to those skilled in the art using protein A.

TABLE 2

| Protease-activated IgG antibody-like molecules with incorporated VHH binding to CD3 | | |
|---|---|---|
| IgG antibody-like molecule | SEQ ID NO of heavy chain | SEQ ID NO of light chain |
| bC3edL1R1N160H01-G1mISHI01/VK1-39-k0MT | 64 | 3 |
| bC3edL1R1N161H01-G1mISHI01/VK1-39-k0MT | 65 | |
| bC3edL1R1N164H01-G1mISHI01/VK1-39-k0MT | 66 | |

Figure 18:
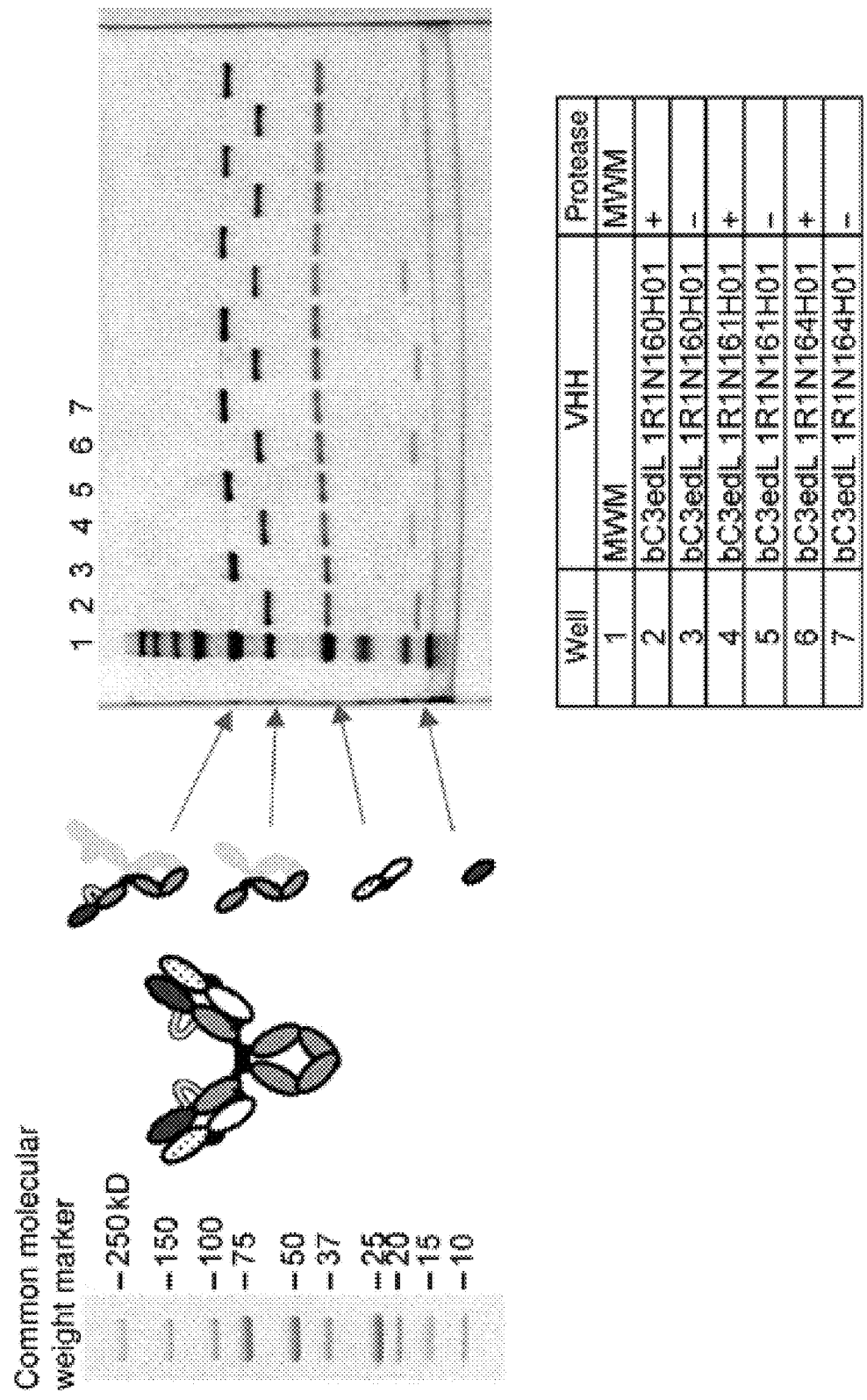

5-4 Activation of Protease-Activated IgG Antibody-Like Molecule by Protease Cleavage The IgG antibody-like molecules prepared in Example 5-3 were cleaved by protease in the same way as in Example 3, and the degree of the cleavage was evaluated by reducing SDS-PAGE. The results are shown in FIG. 18. The protease concentration was set to 25 nM, and Octet RED (Pall ForteBio Corp.) was used in the assay.

As a result, the IgG antibody-like molecules were confirmed to undergo protease cleavage at the protease cleavage sequence.

Figure 19:
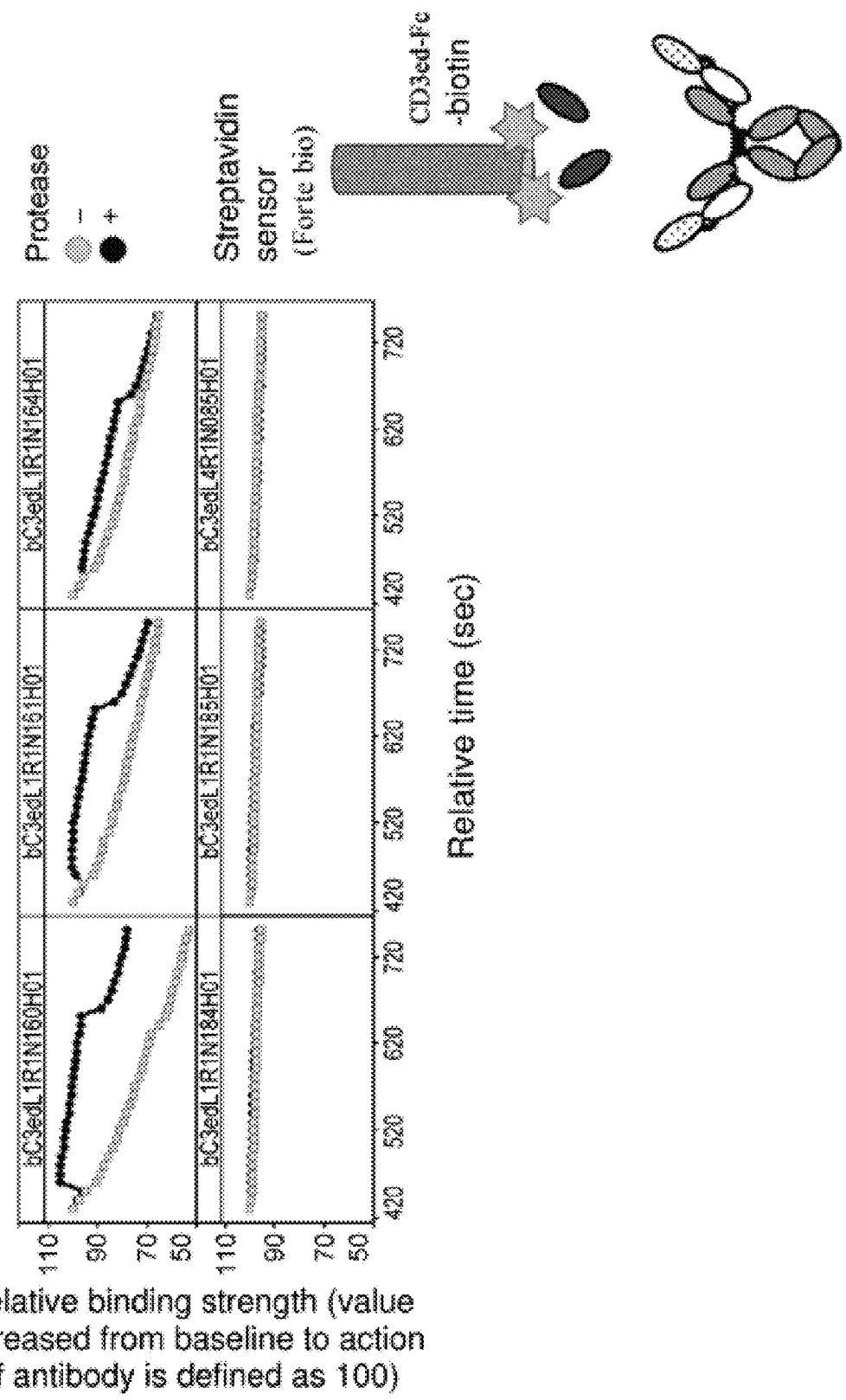

Next, the CD3 binding evaluation of VHH released by protease treatment was conducted in the same way as in Example 3. Octet sensorgrams are shown in FIG. 19.

As a result, the IgG antibody-like molecules bC3edL1R1N16OH01-G1mISHI01/VK1-39-k0MT, bC3edL1R1N161H01-G1mISHI01/VK1-39-k0MT, and bC3edL1R1N164H01-G1mISHI01/VK1-39-k0MT did not exhibit antigen binding before the protease treatment, whereas the antigen binding was confirmed after the protease treatment. The plurality of VHH molecules binding to CD3 molecules, obtained in the same way as in the VHH described in Table 1, was also used to prepare an IgG-like molecule containing the same protease cleavage site as in the IgG antibody-like molecules described in Table 2. As a result, the antigen binding was confirmed by protease treatment. These results demonstrated that in addition to the polypeptides shown in Examples 3 and 4, an IgG antibody-like molecule harboring a protease cleavage sequence can undergo cleavage at the protease cleavage sequence by protease treatment and thereby release the antigen binding domain, and the released antigen binding domain can bind to the antigen.

Example 6 Polypeptide Harboring Protease Cleavage Sequence in its Light Chain

Light chains VK1-39P-2-Pk0MT (SEQ ID NO: 67), VK1-39P-1-Pk0MT (SEQ ID NO: 68), VK1-39P-Pk0MT (SEQ ID NO: 69), VK1-39P+2-Pk0MT (SEQ ID NO: 70), VK1-39P+3-Pk0MT (SEQ ID NO: 71), VK1-39P+4-Pk0MT (SEQ ID NO: 72), and VK1-39P+5-Pk0MT (SEQ ID NO: 73) harboring a protease cleavage sequence at each position were prepared in the same way as in Example 3.

IgG antibody-like molecules were expressed and purified in the same way as in Example 3 using these light chains and IL6R90-G1m (SEQ ID NO: 2) as a heavy chain. The protease concentration was set to 25 nM. IL6R90-G1m/VK1-39-k0MT (heavy chain: SEQ ID NO: 2, light chain: SEQ ID NO: 3) was used as an IgG antibody-like molecule harboring no cleavage sequence.

Figure 20:
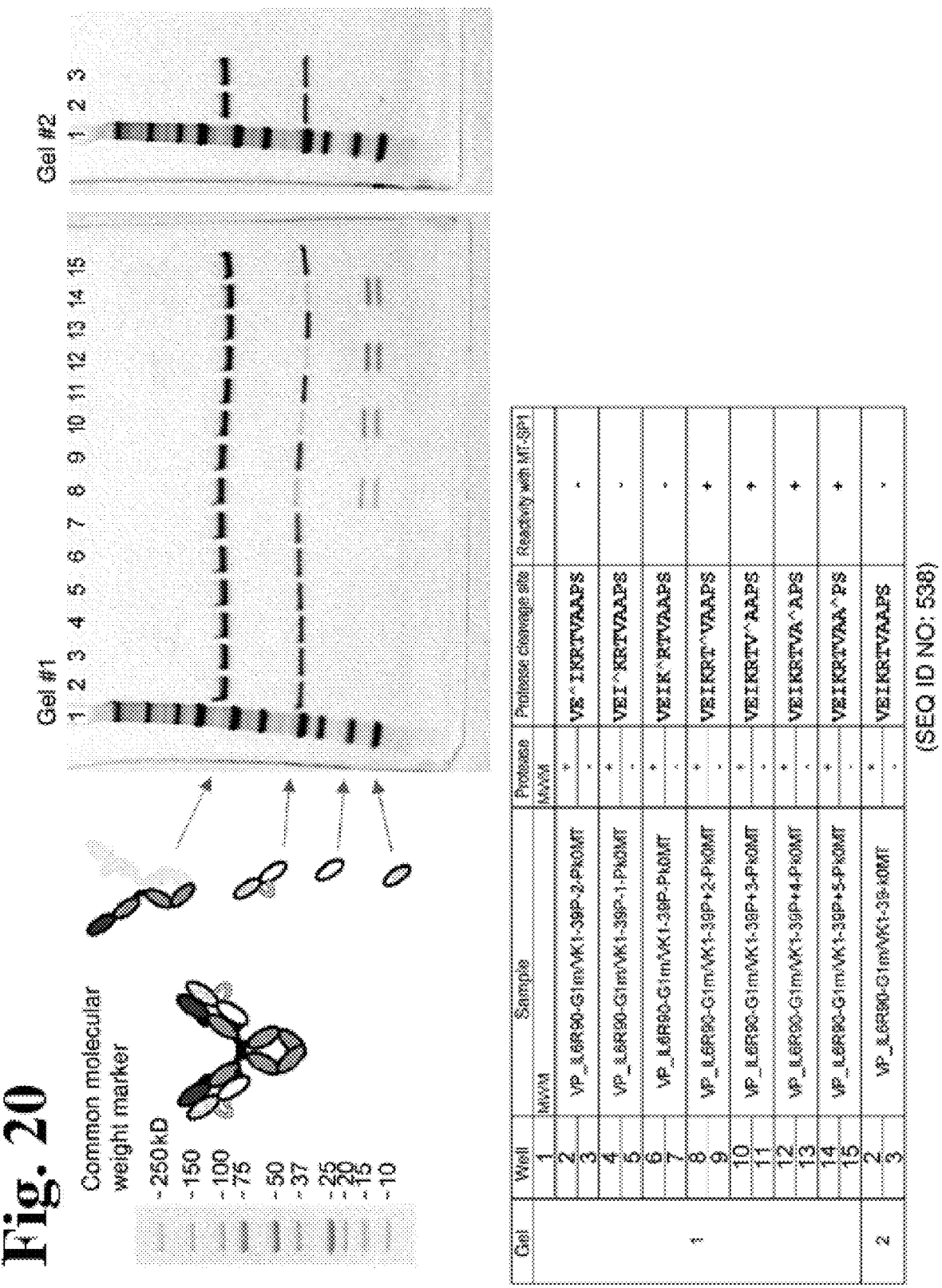
Figure 21:
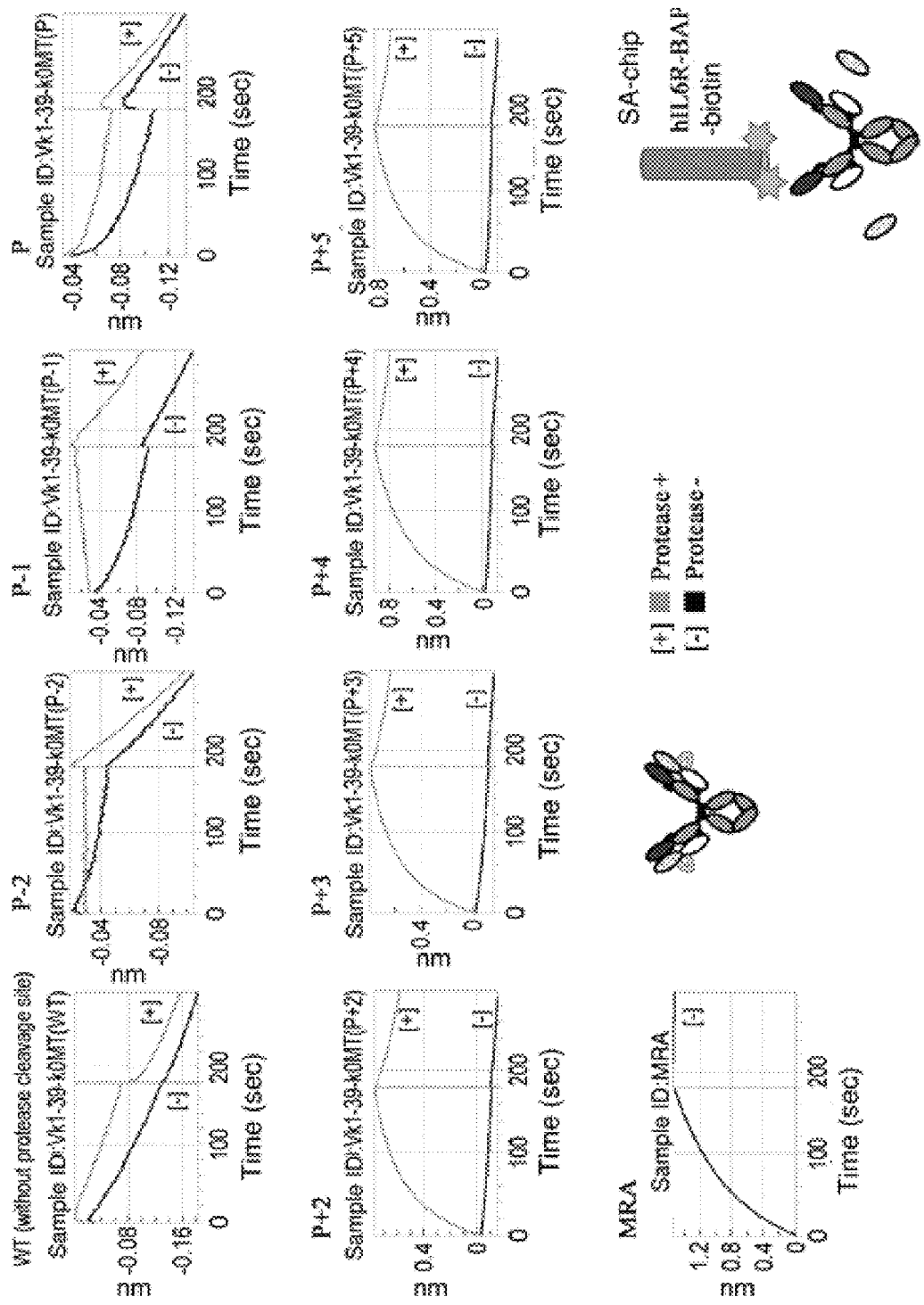

Subsequently, the prepared IgG antibody-like molecules were cleaved by protease in the same way as in Example 3, and the degree of the cleavage was evaluated by reducing SDS-PAGE. The results are shown in FIG. 20. As a result, VK1-39P+2-Pk0MT (SEQ ID NO: 70), VK1-39P+3-Pk0MT (SEQ ID NO: 71), VK1-39P+4-Pk0MT (SEQ ID NO: 72), and VK1-39P+5-Pk0MT (SEQ ID NO: 73) were confirmed to undergo protease cleavage at the protease cleavage sequence. The IL6R binding evaluation of VHH exposed by protease treatment was further conducted in the same way as in Example 3. Octet sensorgrams are shown in FIG. 21. As a result, the binding was also confirmed by the protease treatment of the cleavage sequence introduced into the light chain, demonstrating that a protease-activated polypeptide harboring a protease cleavage sequence in its light chain can be obtained such that the antigen binding domain is exposed to exhibit antigen binding capacity by the protease cleavage of the light chain.

Example 7 Library Containing Heavy Chain Having Antigen Binding Domain and Light Chain Harboring Protease Cleavage Sequence, and Obtainment of Protease-Activated Polypeptide by Phage Display Method from the Library As confirmed in Example 6, even when a protease cleavage sequence is introduced into the light chain of a protease-activated polypeptide, the antigen binding domain is exposed after cleavage of the light chain to bind to the antigen.

Accordingly, a heavy chain containing an antigen binding domain such as a single-domain antibody and a light chain harboring a protease cleavage sequence are incorporated in a phagemid and presented by a phage. A plurality of phagemids for phage display containing different types of antigen binding domains are constructed, followed by phage production from E. coli retaining these phagemids. A phage population is precipitated by the addition of 2.5 M NaCl/ 10% PEG to the culture solution of the E. coli after the phage production, and then diluted with TBS to obtain a phage library solution. BSA is added to the phage library solution so as to attain a final BSA concentration of 4%.

The protease-activated polypeptide is obtained by panning from the phage library thus prepared. The panning is performed with reference to a general panning method using an antigen immobilized on magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). Phages unbound with the antigen-immobilized magnetic beads are recovered before addition of protease, and phages bound with the antigen-immobilized magnetic beads are recovered after addition of protease. The magnetic beads used are NeutrAvidin coated beads (Sera-Mag SpeedBeads NeutrAvidin-coated, FG beads NeutrAvidin) or Streptavidin coated beads (Dynabeads M-280 Streptavidin). An antigen binding clone may be selected from the recovered phages by phage ELISA described in the preceding section, or the antibody gene is subcloned into a vector for expression in animals and expressed using animal cells, and the binding activity is compared between before and after protease treatment to select a binding clone.

Example 8 Library Containing Heavy Chain Having Antigen Binding Domain and Light Chain, and Obtainment of Heavy Chain Whose Antigen Binding Capacity is Controlled by Light Chain by Phage Display Method from the Library As confirmed in Example 3, the antigen binding capacity of a heavy chain containing an antigen binding domain is controlled by the association of a light chain. Accordingly, a heavy chain that loses its antigen binding capacity when associated with a light chain and exhibits antigen binding capacity when presented alone or in combination with a light chain constant region is obtained by the phage display method.

A heavy chain containing an antigen binding domain such as a single-domain antibody is incorporated in a phagemid and presented by a phage. A plurality of phagemids for phage display containing different types of antigen binding domains are constructed, followed by phage production from E. coli retaining these phagemids. A phage population is precipitated by the addition of 2.5 M NaCl/10% PEG to the culture solution of the E. coli after the phage production, and then diluted with TBS to obtain a phage library solution. BSA is added to the phage library solution so as to attain a final BSA concentration of 4%.

The heavy chain that exhibits antigen binding capacity when presented alone or in combination with a light chain constant region and loses its antigen binding capacity when associated with the light chain variable region is obtained by panning from the phage library thus prepared. The panning is performed with reference to the panning method using an antigen immobilized on magnetic beads described in Example 5. Phages bound with the antigen-immobilized magnetic beads are recovered from the phage library displaying heavy chains or heavy chains with light chain constant regions. The recovered phages are allowed to infect E. coli, and phages displaying heavy and light chains are produced using a helper phage expressing a light chain. Phages displaying a heavy chain containing an antigen binding domain and a light chain are obtained by the method mentioned above from the culture solution of the E. coli after the phage production. Phages unbound with the antigen-immobilized magnetic beads are recovered from the population of phages displaying heavy and light chains.

As shown in FIG. 9D, the panning may be carried out by changing the order of the recovery of a phage population displaying a heavy chain, either alone or in combination with a light chain constant region, binding to antigen-immobilized magnetic beads, and the recovery of a phage population displaying heavy and light chains without binding to antigen-immobilized magnetic beads. In addition to the method of expressing a light chain using a helper phage, a region encoding a light chain and a region encoding a heavy chain may be incorporated to the same phagemid as usual, and a gene encoding only a light chain constant region or a full-length light chain may be incorporated in each cycle of panning and used.

An antigen binding clone may be selected from the recovered phages by phage ELISA described in the preceding section, or the antibody gene is subcloned into a vector for expression in animals and expressed using animal cells, and the binding activity is compared between before and after protease treatment to select a binding clone.

Example 9 Obtainment of VHH Whose Antigen Binding Capacity is Controlled by Light Chain by Use of Phage Display Method, and Preparation of IgG Antibody-Like Molecule Containing the VHH In Example 3, it was confirmed that the antigen binding capacity of VHH contained as a substitute for VH in a heavy chain is controlled by association with a light chain. Accordingly, VHH that lost its antigen binding capacity when associated with a particular light chain and exhibited antigen binding capacity when the heavy chain was presented alone or in combination with a light chain constant region, i.e., when not associated with a light chain variable region, was obtained from a phage library displaying CH1 linked to VHH derived from immunized alpaca PBMC. An IgG antibody-like molecule containing the VHH was prepared.
9-1 Construction of Light Chain-Expressing Helper Phage with Integrated Light Chain Expression Unit On the basis of a method described in International Publication No. WO2015/046554, a promoter, a signal sequence, antibody light chain variable region and light chain constant region genes or a light chain constant region gene, etc. were integrated into the genome of a helper phage to construct a light chain-expressing helper phage. E. coli infected with this helper phage is capable of expressing the antibody light chain variable region and the light chain constant region, or only the light chain constant region.

Specifically, the genome was extracted from a helper phage M13K07TC constructed by the method described in International Publication No. WO2015/046554, and a light chain expression unit was introduced to the genome. A gene encoding a light chain variable region and a light chain constant region (VK1-39-kOMTdC; SEQ ID NO: 152), or a gene encoding a light chain constant region (kOMTdC; SEQ ID NO: 153) was used as the light chain gene to be introduced. lac promoter-pelB signal sequence-light chain gene was inserted into M13K07TC/SacI by the method described above and transferred to an E. coli line ER2738 by the electroporation method.

The obtained E. coli was cultured, and 2.5 M NaCl/10% PEG was added to the culture supernatant to purify helper phages by the PEG precipitation method. The titers of the obtained helper phages M13K07TC-Vk1-39-kOMTdC and M13K07TC-kOMTdC were confirmed by the general plaque formation method.

9-2 Preparation of Library Containing a Plurality of VHH-CH1 Molecules

Alpacas were immunized by a method known to those skilled in the art using 4 types of immunogens: a human IL6R extracellular domain, a human CD3 epsilon gamma heterodimer, a monkey CD3 epsilon gamma heterodimer and a cell domain of human plexin A1. 4 weeks later, PBMC was recovered. The CD3 epsilon gamma heterodimers were prepared with reference to Journal of Molecular Biology (2000) 302: 899-916. From the recovered PBMC, VHH gene was amplified with reference to a method described in J. Immunol. Methods (2007) 324, 13. The amplified VHH gene fragment was connected with CH1-gene 3 gene and inserted into phagemid vectors to prepare a library containing a plurality of VHH-CH1 molecules containing VHH linked to CHL.

9-3 Method for Preparing Phage Population Displaying VHH-CH1/Full-Length Light Chain or VHH-CH1/Light Chain Constant Region A phagemid vector having an insert of a gene encoding VHH-CH1 is transferred to *E. coli* by the electroporation method. The obtained *E. coli* can be cultured and infected by the helper phage M13K07TC-Vk1-39-kOMTdC prepared in Example 9-1 so that VHH-CH1 expressed from the phagemid vector and the full-length light chain expressed from the helper phage form a Fab structure to prepare a phage population displaying VHH-CH1/full-length light chain (VHH-CH1/Vk1-39-kOMTdC) on the surface of phagemids containing the gene encoding VHH-CH1. Also, the *E. coli* harboring the phagemid vector having an insert of a gene encoding VHH-CH1 can be cultured and infected by the helper phage M13K07TC-kOMTdC prepared in Example 9-1 so that VHH-CH1 expressed from the phagemid vector and the light chain constant region expressed from the helper phage form a structure of VHH-CH1 and CL associated to prepare a phage population displaying VHH-CH1/light chain constant region (VHH-CH1/kOMTdC). 2.5 M NaCl/10% PEG can be added to the culture supernatant to purify phages by the PEG precipitation method. The titers of the obtained phages can be confirmed by the general plaque formation method.

9-4 Obtainment of VHH-CH1 Containing Plexin A1 VHH Whose Antigen Binding is Inhibited by Association with Light Chain Variable Region and that Exhibits Antigen Binding Capacity in Absence of Light Chain Variable Region, from VHH-CH1 Phage Library VHH-CH1 containing VHH whose antigen binding was inhibited by association with a light chain variable region and that exhibited antigen binding capacity in absence of the light chain variable region was obtained by panning from the VHH-CH1 library prepared in Example 9-2.

The antigen used was biotin-labeled human plexin A1 prepared in Reference Example.

The panning method was performed according to the following steps:

(1) A phage population displaying VHH-CH1/light chain constant region (VHH-CH1/kOMTdC) is produced by the method of Example 9-3 from the VHH-CH1 phage library prepared in Example 9-2, and phages bound with antigen-immobilized magnetic beads are recovered from the population.

(2) A phage population displaying VHH-CH1/full-length light chain (VHH-CH1/Vk1-39-kOMTdC) is produced by the method of Example 9-3 from the recovered phages, and phages unbound with the antigen-immobilized magnetic beads are recovered from the population.

(3) The recovered phages are repetitively subjected to the steps (1) and (2) to recover the desired phage.

As a result of the panning, a plurality of VHH-CH1 molecules were able to be selected whose plexin A1 binding was inhibited by association with the light chain Vk1-39-kOMTdC and that exhibited binding capacity against plexin A1 in the absence of the light chain variable region.

Another panning method was performed according to the following steps:

(1) A phage population displaying VHH-CH1/light chain constant region (VHH-CH1/kOMTdC) is produced by the method of Example 9-3 from the VHH-CH1 phage library prepared in Example 9-2, and phages bound with antigen-immobilized magnetic beads are recovered from the population.

(2) A phage population displaying VHH-CH1/full-length light chain (VHH-CH1/Vk1-39-kOMTdC) is produced by the method of Example 9-3 from the recovered phages, and phages unbound with the antigen-immobilized magnetic beads are recovered from the population. Phages binding to anti-light chain antibody (EY Laboratories, Inc., Cat. BAT-2107-2)-immobilized magnetic beads are further recovered from the recovered phages.

(3) The recovered phages are repetitively subjected to the steps (1) and (2) to recover the desired phage.

As a result of the panning, a plurality of VHH-CH1 molecules were able to be selected whose plexin A1 binding was inhibited by association with the light chain Vk1-39-kOMTdC and that exhibited binding capacity against plexin A1 in the absence of the light chain variable region.

The VHH in the VHH-CH1 thus selected by panning can be used in the preparation of IgG antibody-like molecules.

9-5 Preparation of Protease-Activated IgG Antibody-Like Molecule with Incorporated VHH Binding to Plexin A1

A nucleotide sequence encoding the VHH contained in each VHH-CH1 molecule selected in Example 9-4 was connected to a nucleotide sequence encoding a protease cleavage site and a heavy chain constant region by the method described in Example 3. The resultant was used as the heavy chain of an IgG antibody-like molecule and combined with a full-length light chain VK1-39-k0MT (SEQ ID NO: 3). IgG antibody-like molecules were expressed by transient expression using FreeStyle 293 cells (Invitrogen Corp.) by a method known to those skilled in the art, and purified by a method known to those skilled in the art using protein A.

The prepared IgG antibody-like molecules are shown in Table 3.

TABLE 3

IgG antibody-like molecules containing VHH binding to human plexin A1

| IgG antibody-like molecule | Heavy chain | | Light chain | |
|---|---|---|---|---|
| | Name | SEQ ID NO | Name | SEQ ID NO |
| PX02-R2_001-G1mISHI01/VK1-39-k0MT | PX02-R2_001-G1mISHI01 | 154 | VK1-39-K0MT | 3 |
| PX02-R4_004-G1mISHI01/VK1-39-k0MT | PX02-R4_004-G1mISHI01 | 155 | | |

TABLE 3-continued

IgG antibody-like molecules containing VHH binding to human plexin A1

| IgG antibody-like molecule | Heavy chain | | Light chain | |
|---|---|---|---|---|
| | Name | SEQ ID NO | Name | SEQ ID NO |
| PX02-R4_017-G1mISHI01/VK1-39-k0MT | PX02-R4_017-G1mISHI01 | 156 | | |
| PX03-R2_006-G1mISHI01/VK1-39-k0MT | PX03-R2_006-G1mISHI01 | 157 | | |
| PX03-R4_009-G1mISHI01/VK1-39-k0MT | PX03-R4_009-G1mISHI01 | 158 | | |

Figure 22:
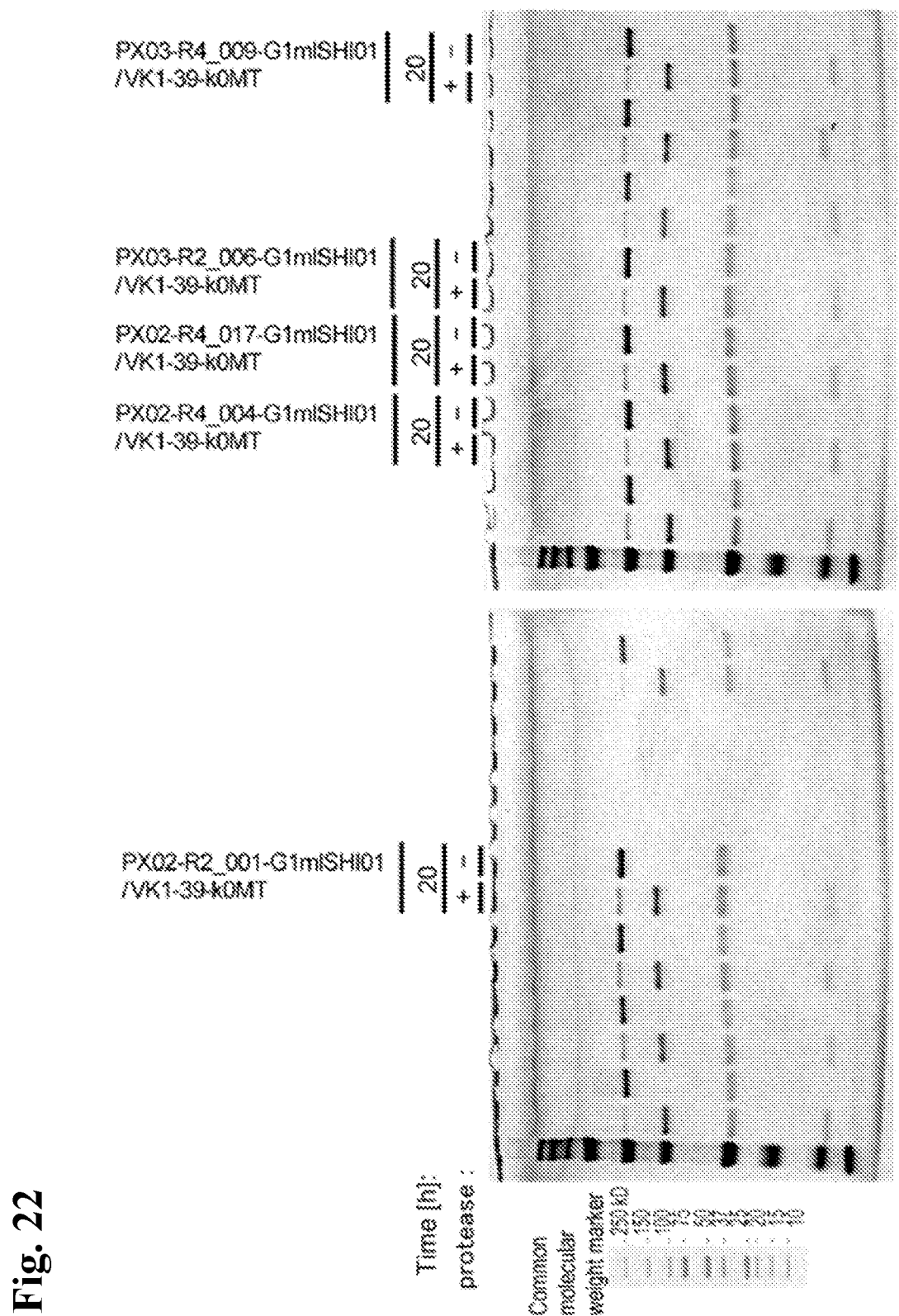

9-6 Activation of Protease-Activated IgG Antibody-Like Molecule by Protease Cleavage The IgG antibody-like molecules prepared in Example 9-4 were cleaved by protease in the same way as in Example 3, and the degree of the cleavage was evaluated by reducing SDS-PAGE. The results are shown in FIG. 22. The protease concentration was set to 25 nM.

As a result, the prepared IgG antibody-like molecules were each confirmed to undergo protease cleavage at the protease cleavage sequence.

Figure 23:
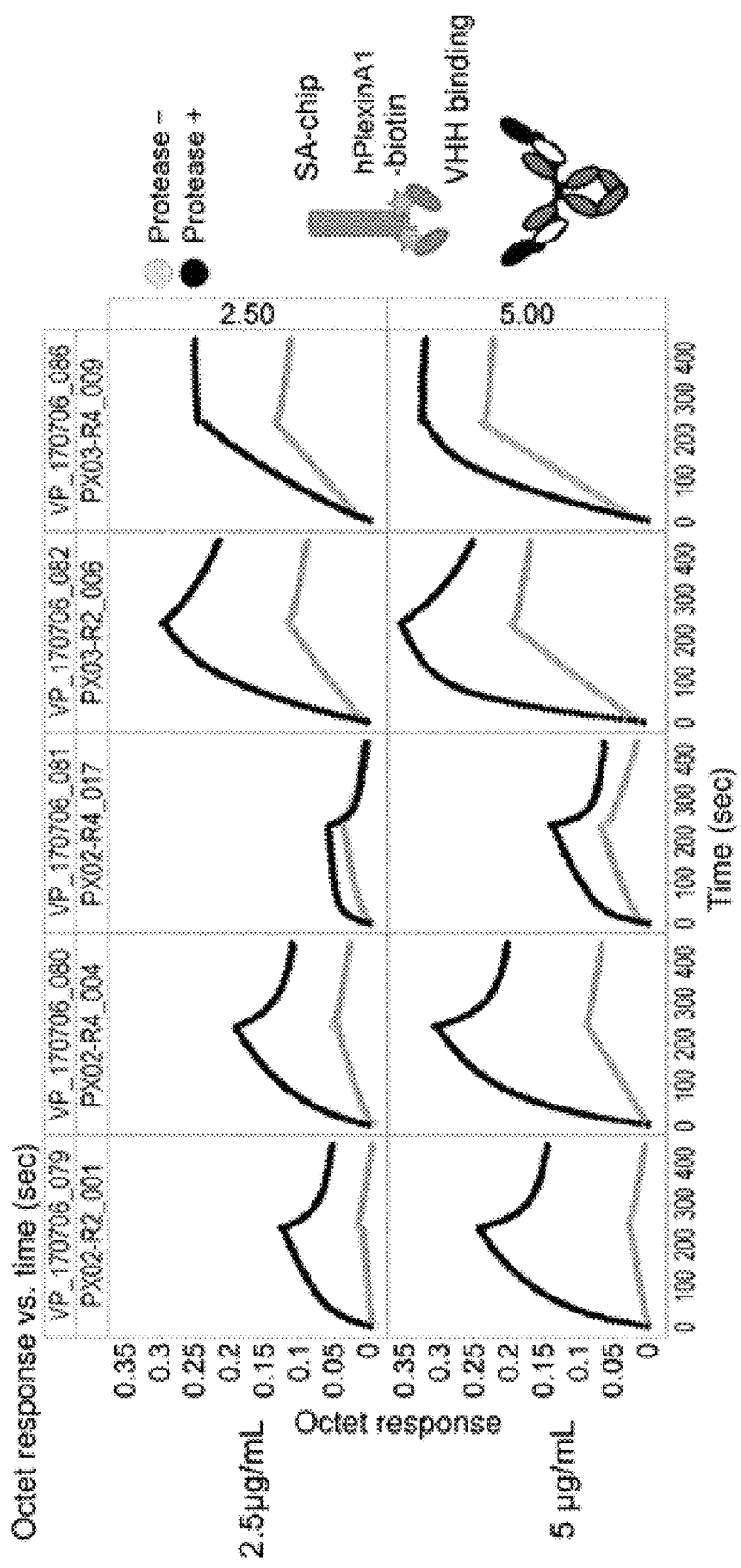

Next, the human plexin A1 binding evaluation of VHH released by protease treatment was conducted in the same way as in Example 3. Octet sensorgrams are shown in FIG. 23.

As a result, each of the prepared IgG antibody-like molecule did not exhibit antigen binding before the protease treatment, whereas the antigen binding of the released VHH was confirmed after the protease treatment.

Example 10 Polypeptide Containing Bispecific VHH-VHH 10-1 Bispecific VHH-VHH Binding to Cancer Antigen and CD3, and Preparation of Polypeptide Containing the Bispecific VHH-VHH As shown in FIG. 8, a protease-activated antigen binding domain may form a bispecific antigen binding molecule with a second antigen binding domain.

VHH HN3 (SEQ ID NO: 159) recognizing human glypican 3 and VHH G03 (SEQ ID NO: 160) recognizing CD3 were connected via a linker constituted by glycine and serine to prepare bispecific VHH-VHH HN3G03. An antibody heavy chain constant region shown in SEQ ID NO: 161 was further connected thereto via a protease cleavage sequence, and the resulting heavy chain HN3G03-cF760mnHIF (SEQ ID NO: 162) containing the bispecific VHH-VHH was inserted into a vector for expression in animals.

VHH HerF07 (SEQ ID NO: 163) recognizing Her2 and VHH G03 (SEQ ID NO: 160) recognizing CD3 were connected via a linker constituted by glycine and serine to prepare bispecific VHH-VHH HerF07G03. An antibody heavy chain constant region shown in SEQ ID NO: 161 was further connected thereto via a protease cleavage sequence, and the resulting heavy chain HerF07G03-cF760mnHIF (SEQ ID NO: 164) containing the bispecific VHH-VHH was inserted into a vector for expression in animals.

Expi293 cells (Life Technologies Corp.) were cotransfected with each heavy chain containing the bispecific VHH-VHH and vectors for expression in animals respectively having inserts of a light chain VK1.39-k0MT (SEQ ID NO: 3) and a human constant region sequence VHn-Kn010dGK (SEQ ID NO: 166) from the hinge region to the C terminus, to express a polypeptide containing the bispecific VHH-VHH. Then, the polypeptide containing the bispecific VHH-VHH was purified by a method known to those skilled in the art using a MonoSpin ProA 96-well plate type (GL Sciences Inc., Cat No.: 7510-11312). The polypeptide containing the bispecific VHH-VHH HN3G03 is HN3G03-cF760mnHIF/VHn-Kn010dGK/VK1.39-k0MT, and the polypeptide containing the bispecific VHH-VHH HerF07G03 is HerF07G03-cF760mnHIF/VHn-Kn010dGK/VK1.39-k0MT.

Figure 24:
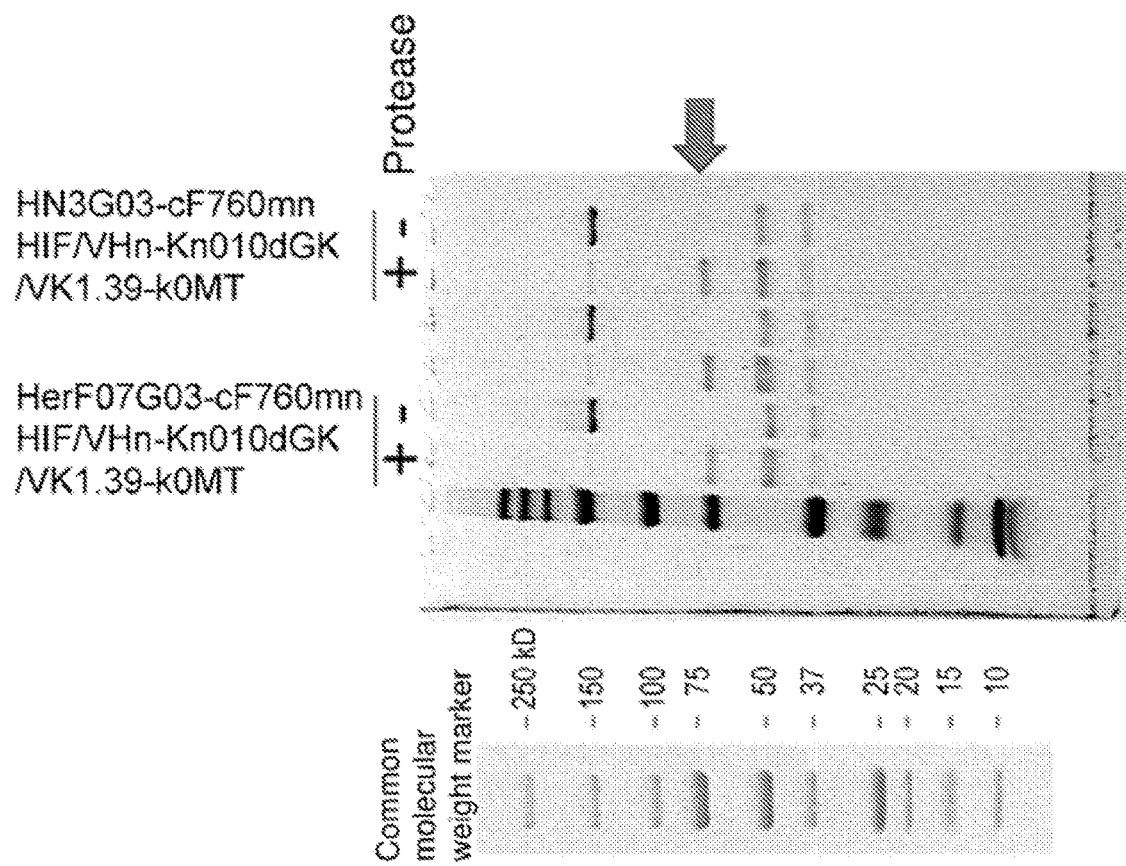
FIG. 24 is a diagram showing SDS-PAGE results of evaluating the protease cleavage of polypeptides containing bispecific VHH-VHH.

For protease treatment, uPA (Recombinant Human u-Plasminogen Activator, R&D Systems, Inc.) (final concentration: 25 nM) was added to 40 micro g of each purified polypeptide containing the bispecific VHH-VHH and incubated at 37 degrees C. for 20 hours or longer. Protease-untreated samples were incubated after addition of PBS instead of protease in the same amount as in the protease. Whether the protease-cleaved polypeptide containing the bispecific VHH-VHH underwent the cleavage as intended was confirmed by reducing SDS-PAGE. The results are shown in FIG. 24. As shown in FIG. 24, it was suggested that the bispecific VHH-VHH was separated from the whole molecule by the protease cleavage.

Figure 25:
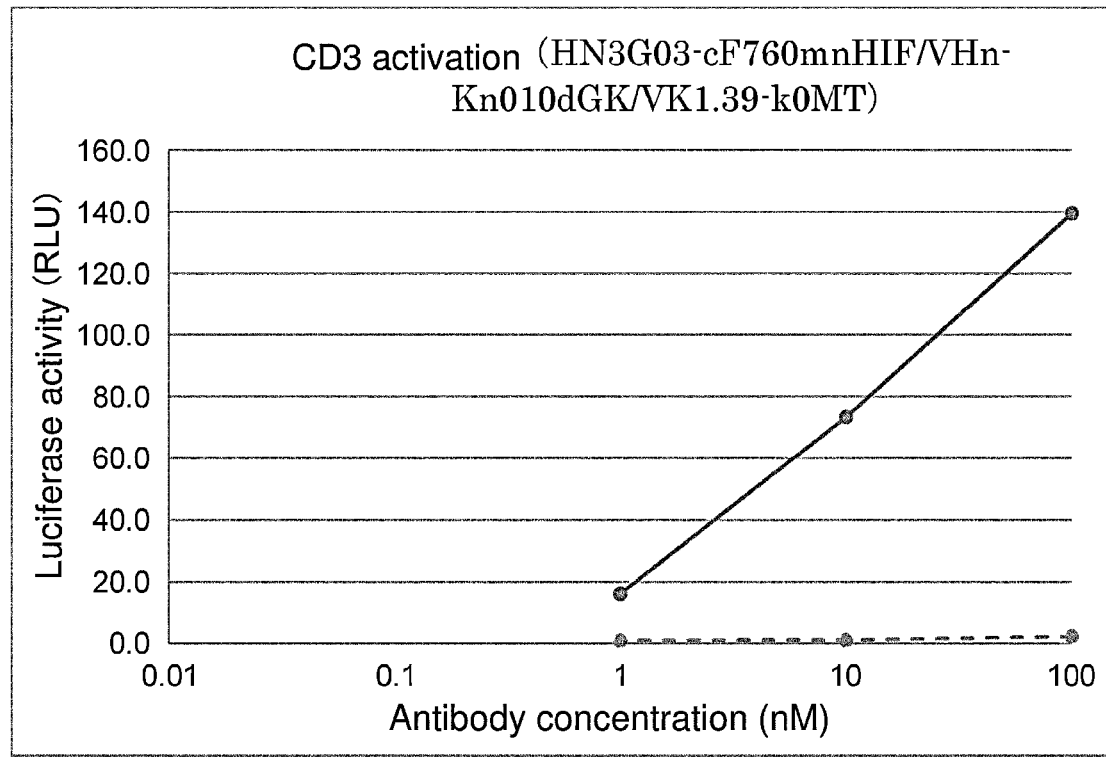
FIG. 25 is a diagram showing luciferase activity before and after protease cleavage. The broken line depicts samples without protease treatment, and the solid line depicts samples with protease treatment.

10-2 CD3 Activation Evaluation of Polypeptide Containing Bispecific VHH-VHH Against GPC3 and CD3 by Protease Cleavage Agonist activity against CD3 was evaluated using Jurkat-NFAT reporter cells (NFAT luc2_jurkat cell). The Jurkat-NFAT reporter cells are a cell line of CD3-expressing human acute T-cell leukemia-derived cells fused with a NFAT response element and luciferase (luc2P) and express luciferase by the activation of a signal downstream of CD3. The target cells used for antibodies based on GPC3 were a SK-pca60 cell line established by forcing a human liver cancer-derived cell line SK-HEP-1 to express human GPC3. The target cells and the effector cells were added at 1.25E+04 cells/well and 7.50E+04 cells/well, respectively, to each well of White-bottomed, 96-well assay plate (Costar, 3917). HN3G03-cF760mnHIF/VHn-Kn010dGK/VK1.39-k0MT with or without protease treatment was added at a final concentration of 1, 10, or 100 nM to the well. After 24-hour incubation at 37 degrees C. in the presence of 5% $CO_2$, the luciferase enzyme activity was measured as luminescence intensity using Bio-Glo luciferase assay system (Promega Corp., G7940) according to the attached protocol. 2104 EnVision was used in detection. The results are shown in FIG. 25. No elevation in luciferase activity was seen in the sample without protease treatment, whereas elevation in luciferase activity was shown in HN3G03-cF760mnHIF/VHn-Kn010dGK/VK1.39-k0MT treated with protease. Specifically, HN3G03-cF760mnHIF/VHn-Kn010dGK/VK1.39-k0MT treated with protease was able to be confirmed to have agonist activity against CD3, while the bispecific VHH-VHH against GPC3 and CD3 was released from HN3G03-cF760mnHIF/VHn-Kn010dGK/VK1.39-k0MT by the protease cleavage and exerted the CD3 binding activity inhibited without cleavage.

Figure 26:
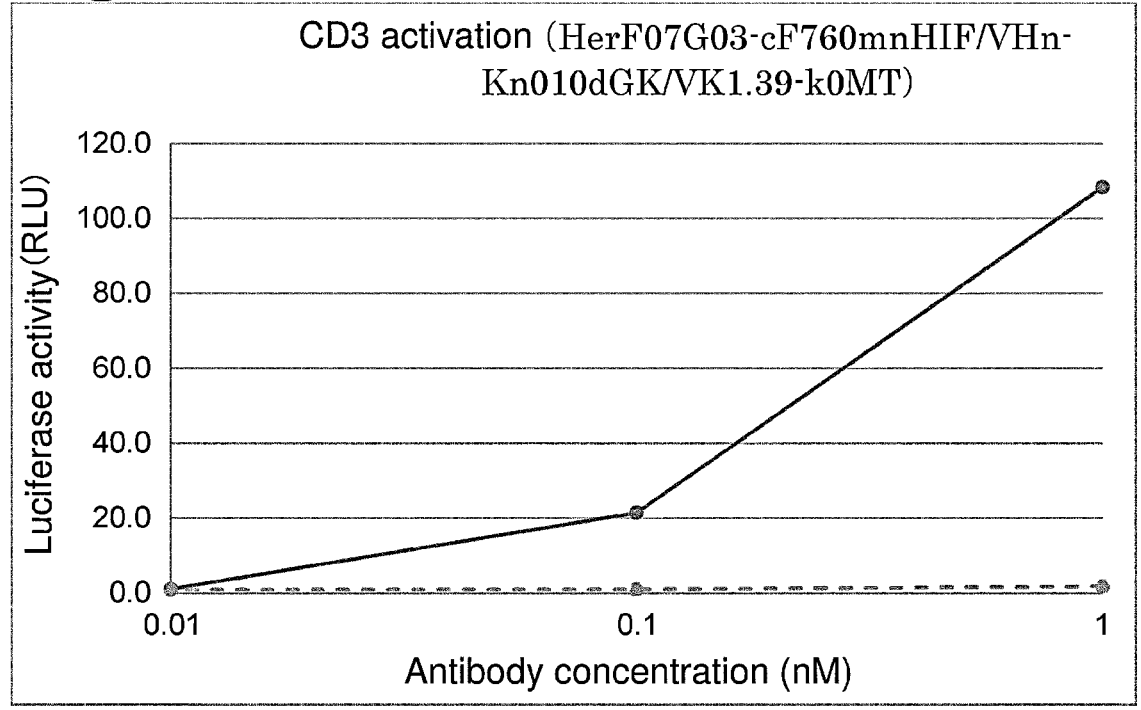
FIG. 26 is a diagram showing luciferase activity before and after protease cleavage. The broken line depicts samples without protease treatment, and the solid line depicts samples with protease treatment.

10-3 CD3 Activation Evaluation of Polypeptide Containing Bispecific VHH-VHH Against Her2 and CD3 by Protease Cleavage Agonist activity against CD3 was evaluated using Jurkat-NFAT reporter cells (NFAT luc2_jurkat cell). The Jurkat-NFAT reporter cells (effector cells) are a cell line of CD3-expressing human acute T-cell leukemia-derived cells fused with a NFAT response element and luciferase (luc2P) and express luciferase by the activation of a signal downstream of CD3. The target cells used were a LS1034 cell line. The target cells and the effector cells were added at 2.50E+04 cells/well and 7.50E+04 cells/well, respectively, to each well of White-bottomed, 96-well assay plate (Costar, 3917). HerF07G03-cF760mnHIF/VHn-Kn010dGK/VK1.39-k0MT with or without protease treatment was added at a final concentration of 0.01, 0.1, and 1 nM to the well. After 24-hour incubation at 37 degrees C. in the presence of 5% $CO_2$, the luciferase enzyme activity was measured as luminescence intensity using Bio-Glo luciferase assay system (Promega Corp., G7940) according to the attached protocol. 2104 EnVision was used in detection. The results are shown in FIG. 26. No elevation in luciferase activity was seen in the sample without protease treatment, whereas elevation in luciferase activity was shown in HerF07G03-cF760mnHIF/VHn-Kn010dGK/VK1.39-k0MT treated with protease. Specifically, HerF07G03-cF760mnHIF/VHn-Kn010dGK/VK1.39-k0MT treated with protease was able to be confirmed to have agonist activity against CD3, while the bispecific VHH-VHH against Her2 and CD3 was released from HerF07G03-cF760mnHIF/VHn-Kn010dGK/VK1.39-k0MT by the protease cleavage and exerted the CD3 binding activity inhibited without cleavage.

Example 11 Introduction of Protease Cleavage Site to Polypeptide with Incorporated VHH 11-1 Introduction of Protease Cleavage Sequence to Polypeptide with Incorporated VHH Binding to IL6R An expression vector encoding IL6R90-G1T4 (SEQ ID NO: 167) containing IL6R90 (SEQ ID NO: 1), VHH having binding and neutralizing activities against human IL6R as described in International Publication No. WO2010/115998, fused with a human IgG1 constant region (CH1-hinge-CH2-CH3) was prepared by a method known to those skilled in the art. An IgG antibody-like molecule IL6R90-G1T4/VK1-39-k0MT (heavy chain: SEQ ID NO: 167, light chain: SEQ ID NO: 3) was expressed by transient expression using FreeStyle 293 cells (Invitrogen Corp.) or Expi293 cells (Life Technologies Corp.) by a method known to those skilled in the art, and purified by a method known to those skilled in the art using protein A.

A protease cleavage sequence shown in SEQ ID NO: 178 was inserted near the boundary between VHH and CH1 in the heavy chain of IL6R90-G1T4/VK1-39-k0MT to prepare a VHH-containing heavy chain IL6R90.12aa-G1T4 (SEQ ID NO: 189) harboring the protease cleavage sequence. An IL6R90.12aa-G1T4 expression vector was prepared by a method known to those skilled in the art.

IL6R90.12aa-G1T4 was combined with a light chain shown in SEQ ID NO: 3. An IgG1 antibody-like molecule IL6R90.12aa-G1T4/VK1-39-k0MT harboring the protease cleavage sequence near the boundary between VHH and CH1 was expressed by transient expression using FreeStyle 293 cells (Invitrogen Corp.) or Expi293 cells (Life Technologies Corp.) by a method known to those skilled in the art, and purified by a method known to those skilled in the art using protein A.

Figure 27:
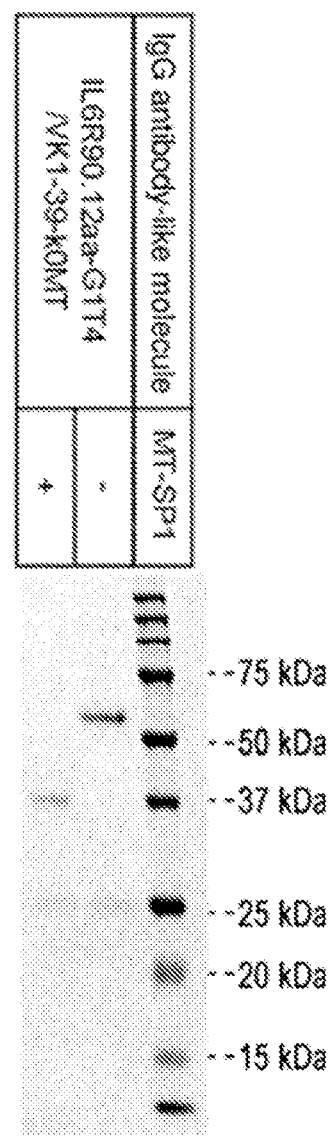
FIG. 27 is a diagram showing the SDS-PAGE evaluation of the protease cleavage of an IgG antibody-like molecule containing anti-human IL6R VHH.

11-2 Protease Cleavage Evaluation of IgG Antibody-Like Molecule Containing Anti-Human IL6R VHH and Harboring Protease Cleavage Sequence in its Heavy Chain Region Whether the IgG antibody-like molecule prepared in Example 11-1 would be cleaved by protease was verified. Recombinant Human Matriptase/ST14 Catalytic Domain (MT-SP1) (R&D Systems, Inc., 3946-SE-010) was used as the protease. 10 nM protease and 50 micro g/mL of the antibody were reacted in PBS under a condition of 37 degrees C. for 20 hours. Then, cleavage by the protease was evaluated by reducing SDS-PAGE. The results are shown in FIG. 27. As a result, the protease treatment of the IgG antibody-like molecule IL6R90.12aa generated a new band around 37 kDa. Thus, the IgG antibody-like molecule was confirmed to undergo protease cleavage at the protease cleavage sequence (SEQ ID NO: 178) inserted near the boundary between VHH and CH1. Also, a protease cleavage sequence represented by SEQ ID NO: 178 was also confirmed to be cleaved by human uPA and mouse uPA when incorporated in an IgG antibody by a similar method.

Example 12 Evaluation of Degree of Activation by Protease Cleavage of IgG Antibody-Like Molecule Harboring Protease Cleavage Sequence in its Light Chain An expression vector encoding IL6R75-G1m (SEQ ID NO: 191) containing IL6R75 (SEQ ID NO: 190), VHH having binding and neutralizing activities against human IL6R as described in International Publication No. WO2010/115998, fused with a human IgG1 constant region (CH1-hinge-CH2-CH3) was prepared by a method known to those skilled in the art. IL6R75hu-G1m (SEQ ID NO: 192) was prepared by introducing amino acid alterations to the interface site between VHH and VL in the same way as in Example 4-2. IgG antibody-like molecules IL6R90-G1m/VK1-39P+4-Pk0MT (heavy chain: SEQ ID NO: 2, light chain: SEQ ID NO: 72), 20A11hu-G1m/K1-39P+4-Pk0MT (heavy chain: SEQ ID NO: 39, light chain: SEQ ID NO: 72), and IL6R75hu-G1m/VK1-39P+4-Pk0MT (heavy chain: SEQ ID NO: 192, light chain: SEQ ID NO: 72) were expressed and purified in the same way as in Example 3 using the protease cleavage sequence-incorporated light chain VK1-39P+4-Pk0MT (SEQ ID NO: 72) and IL6R90-G1m (SEQ ID NO: 2), 20A11hu-G1m (SEQ ID NO: 39), and IL6R75hu-G1m (SEQ ID NO: 192) as heavy chains.

Figure 28:
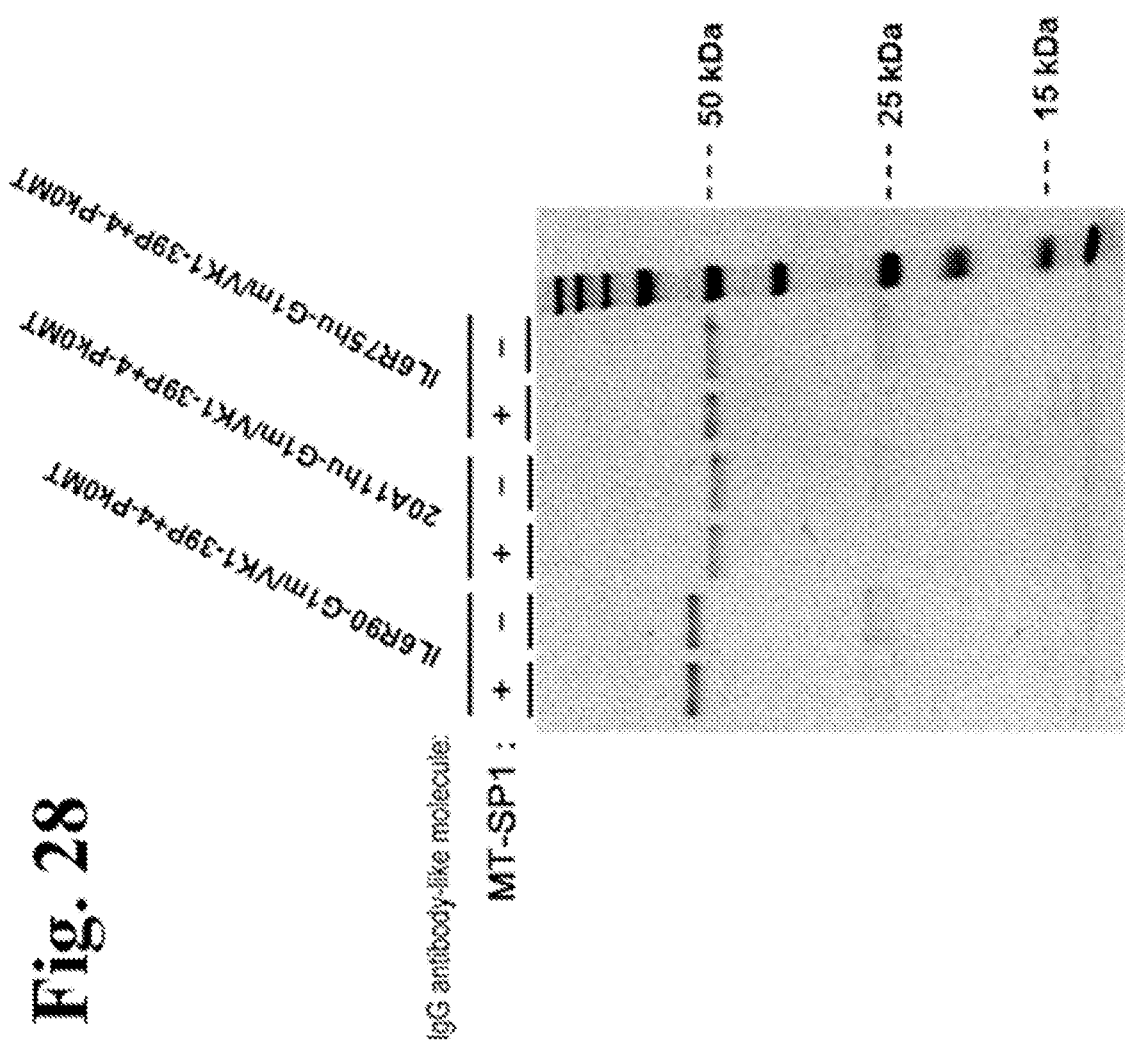
FIG. 28 is a diagram showing the evaluation of the protease cleavage of IgG antibody-like molecules harboring a protease cleavage sequence in their light chains.

IL6R90-G1m/VK1-39P+4-Pk0MT, 20A11hu-G1m/VK1-39P+4-Pk0MT, and IL6R75hu-G1m/VK1-39P+4-Pk0MT were cleaved by protease in the same way as in Example 3, and the degree of the cleavage was evaluated. The results are shown in FIG. 28. Specifically, recombinant Human Matriptase/ST14 Catalytic Domain (R&D Systems, Inc., 3946-SE-010) was used as the protease. 50 nM protease and 50 micro g/mL of each IgG antibody-like molecule were reacted in PBS under a condition of 37 degrees C. for 20 hours. Then, cleavage by the protease was evaluated by reducing SDS-PAGE. As a result, IL6R90-G1m/VK1-39P+4-Pk0MT, 20A11hu-G1m/VK1-39P+4-Pk0MT, and IL6R75hu-G1m/VK1-39P+4-Pk0MT were confirmed to undergo protease cleavage near the boundary between VL and CL.

Figure 29:
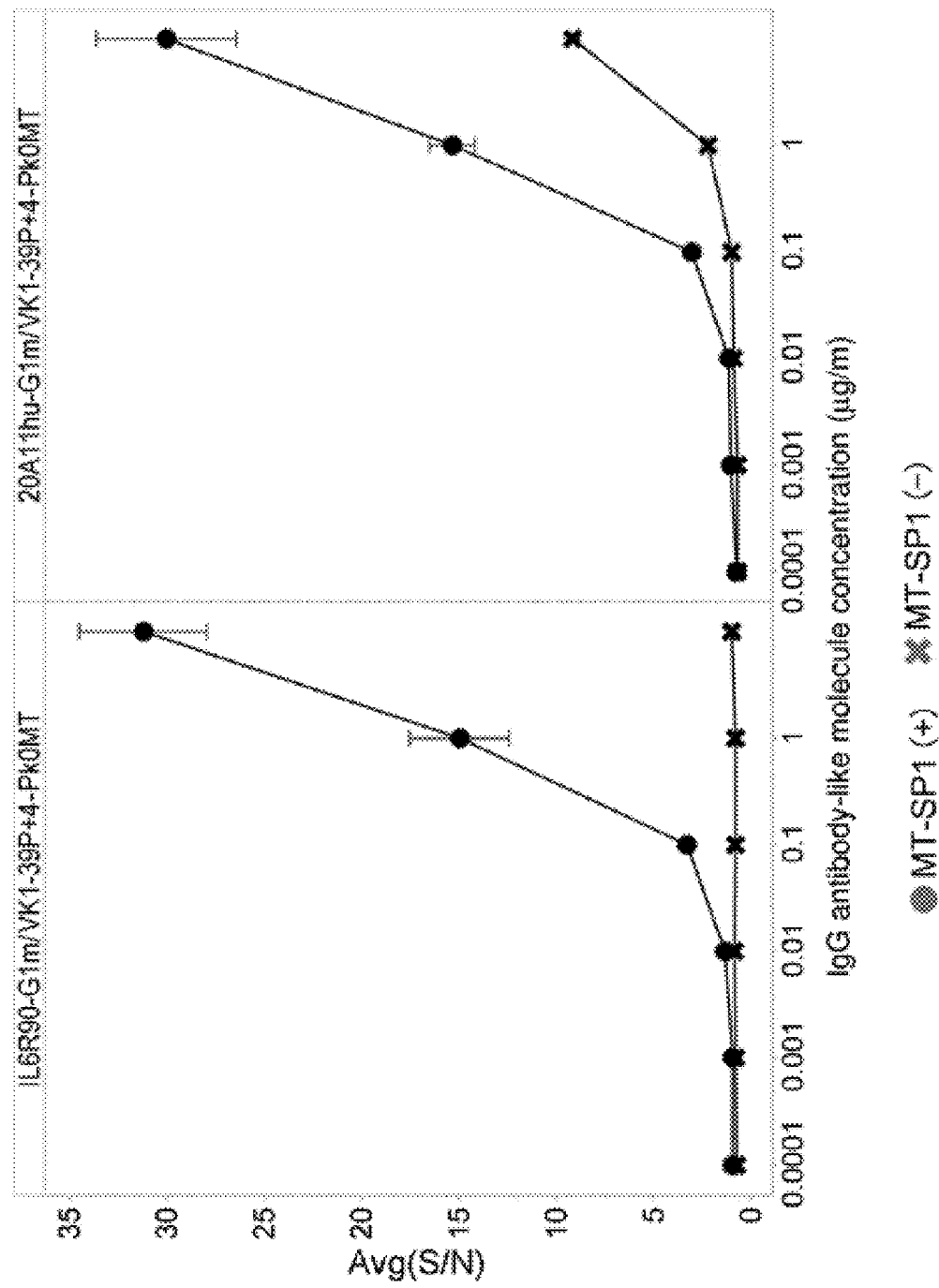
FIG. 29 is a diagram showing the evaluation of the degree of activation based on the presence or absence of the protease treatment of IgG-like antibody molecules harboring a protease cleavage sequence in their light chains.

Next, the IL6R binding of VHH exposed by protease treatment was evaluated by ELISA. Specifically, the hsIL-6R-BAP1 used in Example 3 was immobilized onto a streptavidin-coated 384-well plate (Greiner Bio-One GmbH, 781990), and each cleaved IgG antibody-like molecule was bound thereto at room temperature. After reaction for 30 minutes, a HRP-labeled anti-human IgG antibody (Sigma-Aldrich Co. LLC, SAB3701362-2MG) was allowed to act thereon at room temperature for 10 minutes, and TMB Chromogen Solution (Life Technologies Corp., 002023) was reacted therewith. After reaction at room temperature for 30 minutes, the reaction was terminated with sulfuric acid, followed by the measurement of absorbance at 450 nm using Synergy HTX multi-mode reader (BioTek Instruments, Inc.). The absorbance ratio of the antigen-immobilized wells to unimmobilized wells was calculated and used as a S/N ratio. The S/N ratio (mean) of ELISA was plotted on the ordinate against the concentration of each IgG antibody-like molecule on the abscissa. The results are shown in FIG. 29. These results showed that the protease-treated IgG antibody-like molecule 20A11hu-G1m/VK1-39P+4-Pk0MT harboring the cleavage sequence in its light chain had 10 or more times the IL6R binding activity of the protease-untreated IgG antibody-like molecule, and the protease-treated IgG antibody-like molecule IL6R90-G1m/VK1-39P+4-Pk0MT had 1000 or more times the IL6R binding activity of the protease-untreated one.

Example 13 Preparation and Evaluation of IgG Antibody-Like Molecules Harboring Diverse Protease Cleavage Sequences 13-1 Preparation of Polypeptides Harboring Diverse Protease Cleavage Sequences IgG antibody-like molecules were prepared in the same way as in Example 3 using recognition sequences for proteases other than urokinase or matriptase. Various peptide sequences known to be cleaved by MMP-2, MMP-7, MMP-9, or MMP-13 were each inserted near the boundary between the variable and constant regions of IL6R90-G1m, and a peptide sequence containing a flexible linker consisting of a glycine-serine polymer was inserted in the vicinity of these cleavage sequences. The inserted sequences are shown in Table 4.

TABLE 4

| Various inserted sequences | | |
|---|---|---|
| Protease | Inserted sequence | SEQ ID NO |
| MMP-2 MMP-9 | PLGLAG | 34 |
| MMP-2 | GAGIPVSLRSGAG | 70 |
| MMP-2 | GPLGIAGQ | 71 |
| MMP-2 | GGPLGMLSQS | 72 |
| MMP-2 | PLGLWA | 73 |

TABLE 4-continued

| Various inserted sequences | | |
|---|---|---|
| Protease | Inserted sequence | SEQ ID NO |
| MMP-7 | VPLSLTMG | 35 |
| MMP-7 | GAGVPLSLTMGAG | 75 |
| MMP-9 | GAGVPLSLYSGAG | 76 |
| MMP-13 | GAGPQGLAGQRGIVAG | 91 |
| MMP-2 MMP-9 | GGGGSPLGLAGGGGGS | 193 |
| MMP-2 | GGGGSGPLGIAGQGGGGS | 194 |
| MMP-9 | GGGGSGAGVPLSLYSGAGGGGS | 195 |

Heavy chains were designed such that these sequences were inserted near the boundary between the variable and constant regions of IL6R90-G1m. Expression vectors encoding the heavy chain variants 6R90EIVHEMP2.1-6R90EICHEMP2.1G1m (SEQ ID NO: 165), 6R90EIVHEMP2.2-6R90EICHEMP2.2G1m (SEQ ID NO: 202), 6R90EIVHEMP2.3-6R90EICHEMP2.3G1m (SEQ ID NO: 203), 6R90EIVHEMP2.4-6R90EICHEMP2.4G1m (SEQ ID NO: 204), 6R90EIVHEMP7.1-6R90EICHEMP7.1G1m (SEQ ID NO: 205), 6R90EIVHEMP7.2-6R90EICHEMP7.2G1m (SEQ ID NO: 206), 6R90EIVHEMP13-6R90EICHEMP13G1m (SEQ ID NO: 207), 6R90EIVHEG4SMP2MP9G4S-6R90EICHEG4SMP2MP9G4SG1m (SEQ ID NO: 196), 6R90EIVHEG4SMP2.2G4S-6R90EICHEG4SMP2.2G4SG1m (SEQ ID NO: 197), and 6R90EIVHEG4SMP9G4S-6R90EIVHEG4SMP9G4SG1m (SEQ ID NO: 198) were prepared by a method known to those skilled in the art.

Table 5 shows the IgG antibody-like molecules combining these heavy chain variants with a light chain and harboring the protease cleavage sequence near the boundary between the variable and constant regions of the heavy chain. These IgG antibody-like molecules were expressed by transient expression using FreeStyle 293 cells (Invitrogen Corp.) or Expi293 cells (Life Technologies Corp.) by a method known to those skilled in the art, and purified by a method known to those skilled in the art using protein A.

TABLE 5

| | IgG antibody-like molecules | | |
|---|---|---|---|
| Protease | IgG antibody-like molecule | SEQ ID NO of heavy chain | SEQ ID NO of light chain |
| MMP-2 | 6R90EIVHEMP2. 1-6R90EICHEMP2. 1G1m/VK1-39-k0MT | 165 | 3 |
| MMP-2 | 6R90EIVHEMP2. 2-6R90EICHEMP2. 2G1m/VK1-39-k0MT, | 202 | 3 |
| MMP-2 | 6R90EIVHEMP2. 3-6R90EICHEMP2. 3G1m/VK1-39-k0MT, | 203 | 3 |
| MMP-2 | 6R90EIVHEMP2. 4-6R90EICHEMP2. 4G1m/VK1-39-k0MT, | 204 | 3 |
| MMP-7 | 6R90EIVHEMP7. 1-6R90EICHEMP7. 1G1m/VK1-39-k0MT, | 205 | 3 |
| MMP-7 | 6R90EIVHEMP7. 2-6R90EICHEMP7. 2G1m/VK1-39-k0MT | 206 | 3 |
| MMP-13 | 6R90EIVHEMP13-6R90EICHEMP13G1m/VK1-39-k0MT | 207 | 3 |
| MMP-2 MMP-9 | 6R90EIVHEG4SMP2MP9G4S-6R90EICHEG4SMP2MP9G4SG1m/VK1-39-k0MT | 196 | 3 |
| MMP-2 | 6R90EIVHEG4SMP2. 2G4S-6R90EICHEG4SMP2. 2G4SG1m/VK1-39-k0MT | 197 | 3 |
| MMP-9 | 6R90EIVHEG4SMP9G4S-6R90EICHEG4SMP9G4SG1m/VK1-39-k0MT | 198 | 3 |

Figure 30A:
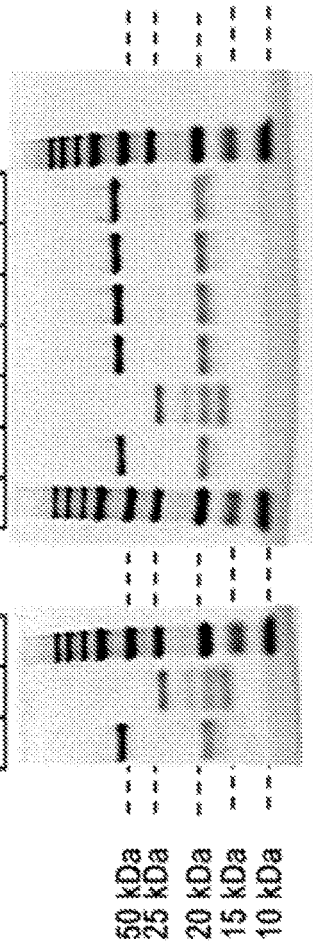
FIG. 30A is a diagram showing the evaluation of the protease cleavage of IgG antibody-like molecules harboring a protease cleavage sequence in their heavy chains.
Figure 30B:
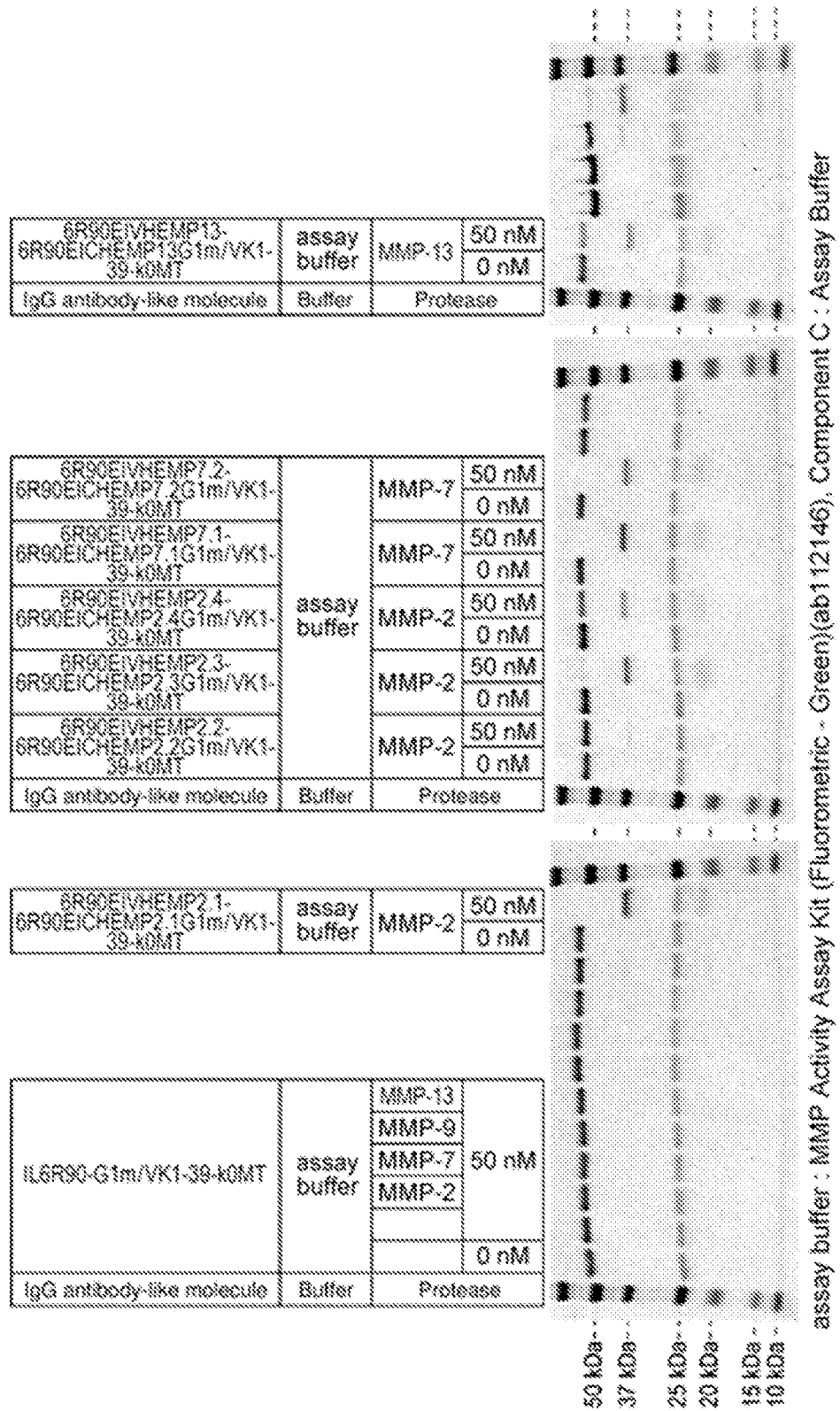
FIG. 30B is a diagram showing the evaluation of the protease cleavage of IgG antibody-like molecules harboring a protease cleavage sequence in their heavy chains. The cleavage by protease was carried out using an assay buffer (MMP Activity Assay Kit (Fluorometric-Green) (ab112146), Component C: Assay Buffer).
Figure 31A:
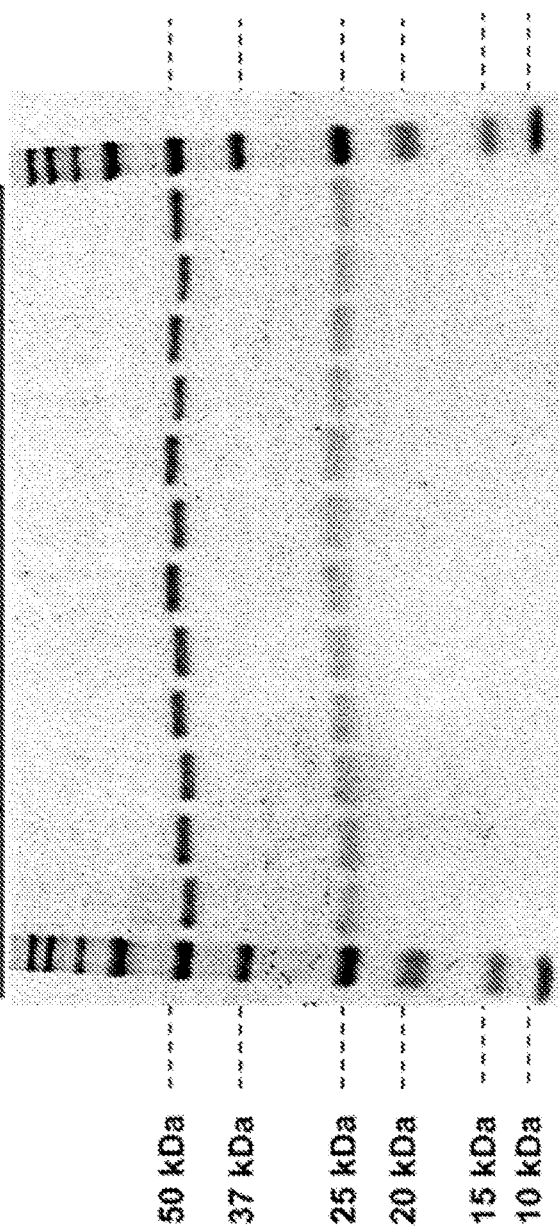
FIG. 31A is a diagram showing results of cleaving engineered MRA antibodies by protease.
Figure 31B:
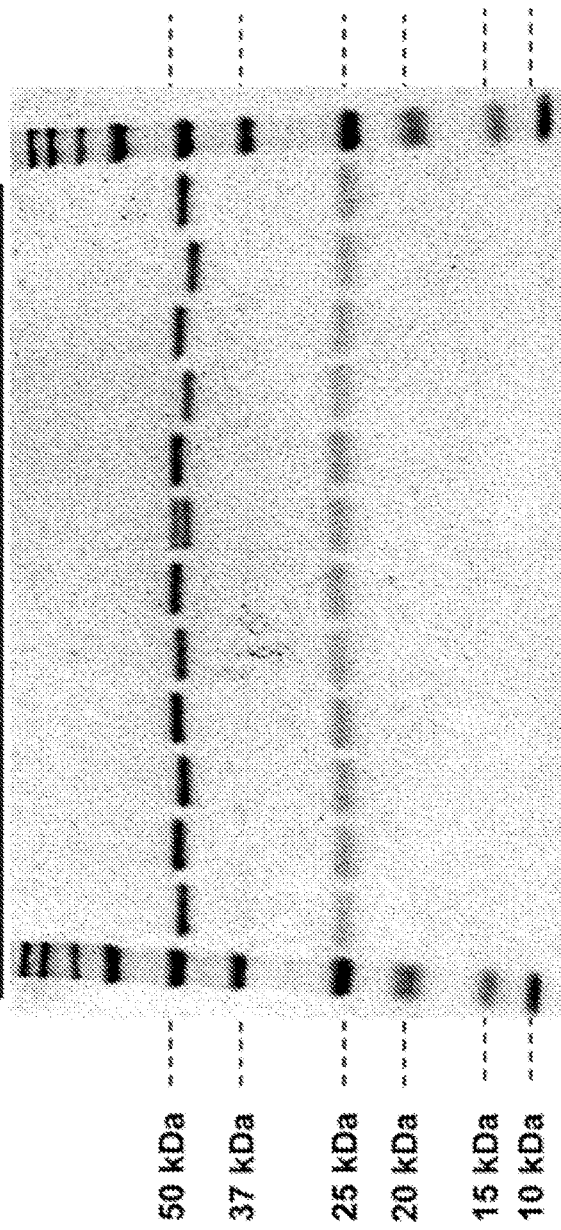
FIG. 31B is a diagram showing results of cleaving engineered MRA antibodies by protease.
Figure 31C:
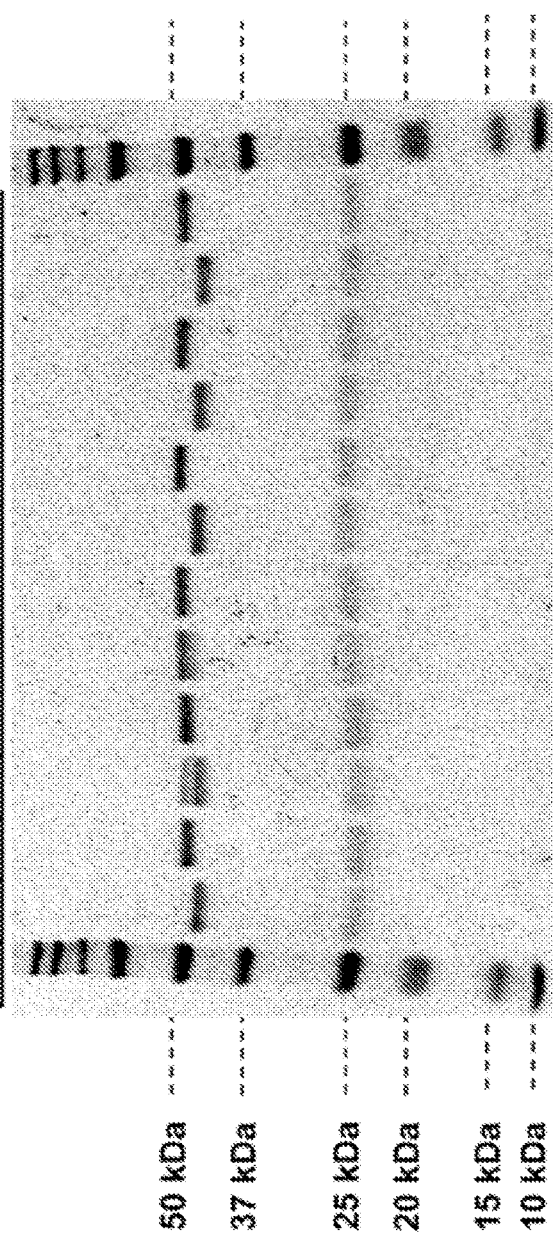
FIG. 31C is a diagram showing results of cleaving engineered MRA antibodies by protease.
Figure 31D:
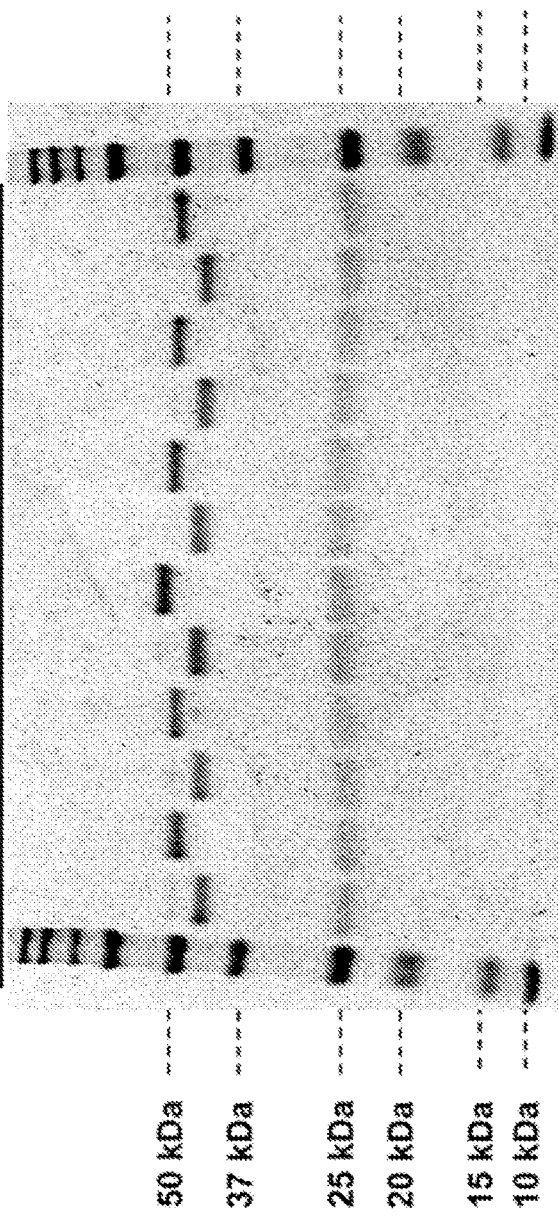
FIG. 31D is a diagram showing results of cleaving engineered MRA antibodies by protease.
Figure 31E:
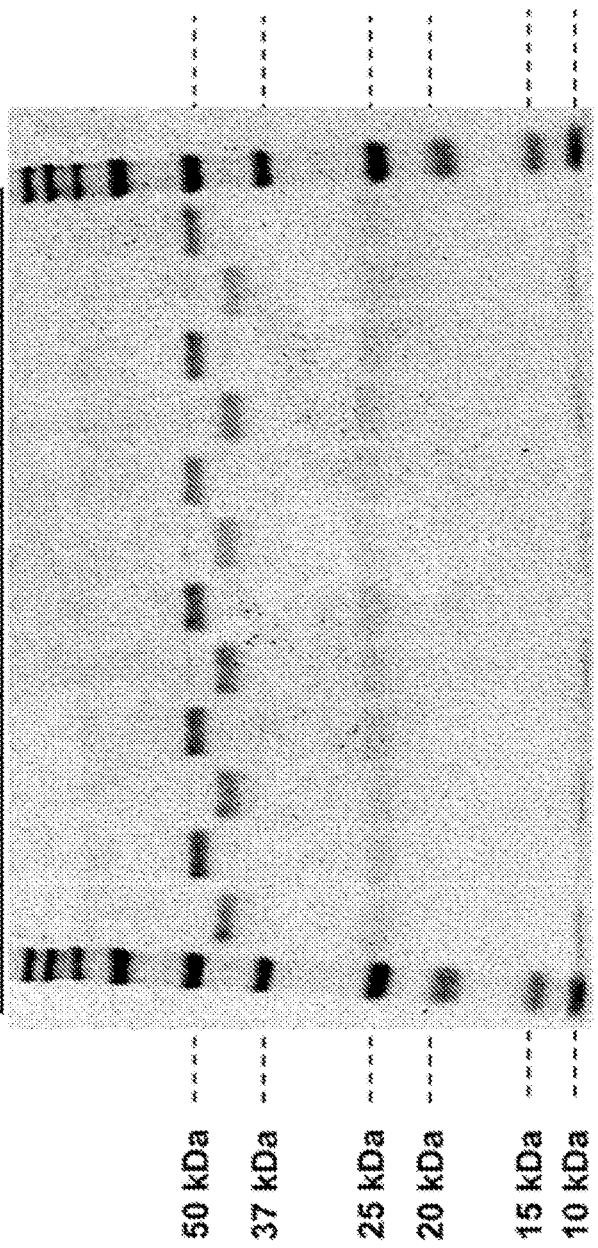
FIG. 31E is a diagram showing results of cleaving engineered MRA antibodies by protease.
Figure 31F:
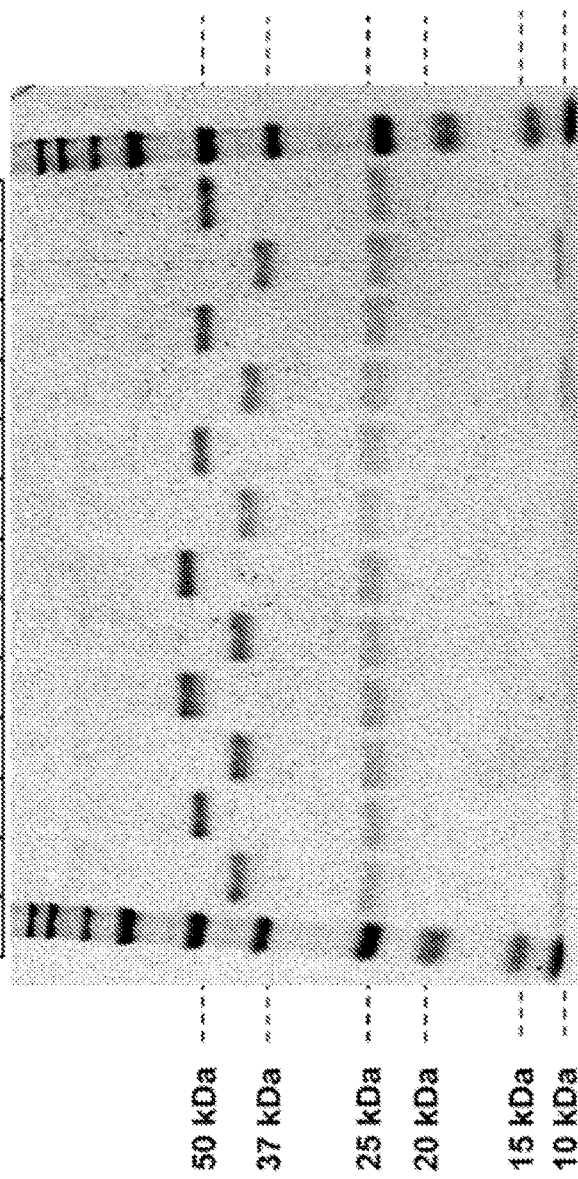
FIG. 31F is a diagram showing results of cleaving engineered MRA antibodies by protease.
Figure 31G:
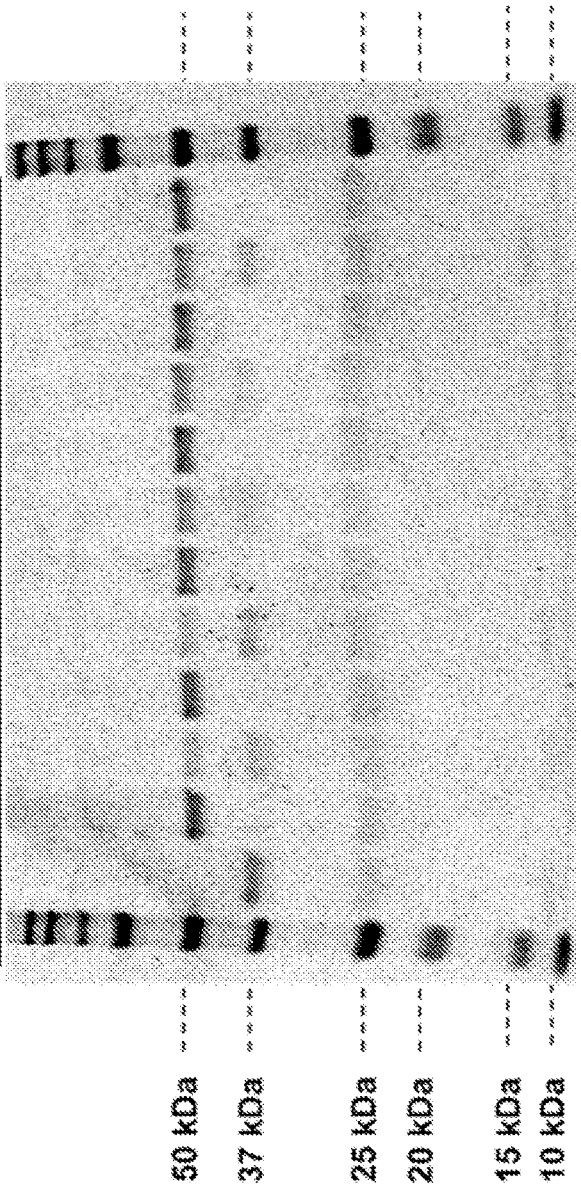
FIG. 31G is a diagram showing results of cleaving engineered MRA antibodies by protease.
Figure 31H:
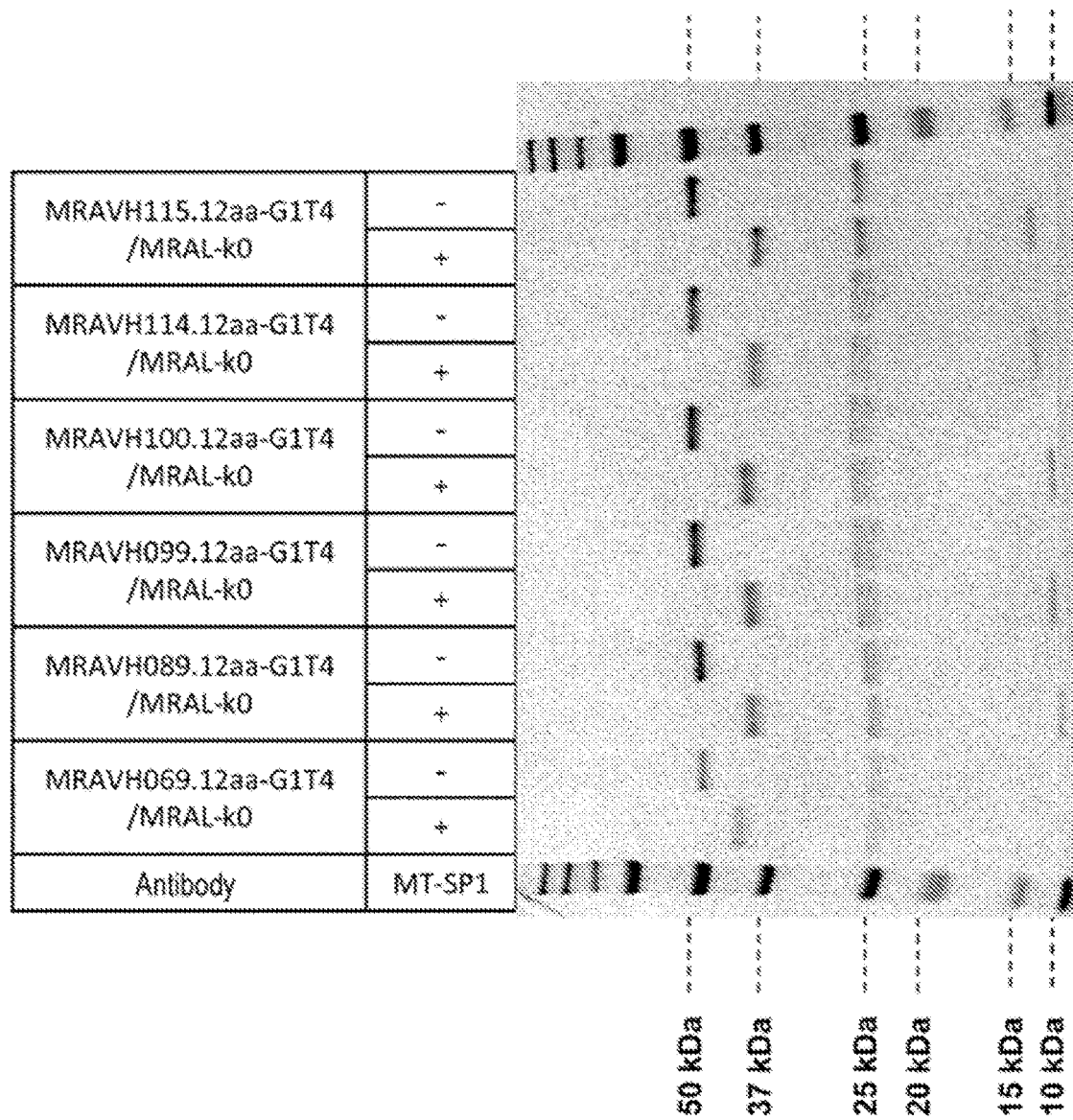
FIG. 31H is a diagram showing results of cleaving engineered MRA antibodies by protease.
Figure 31I:
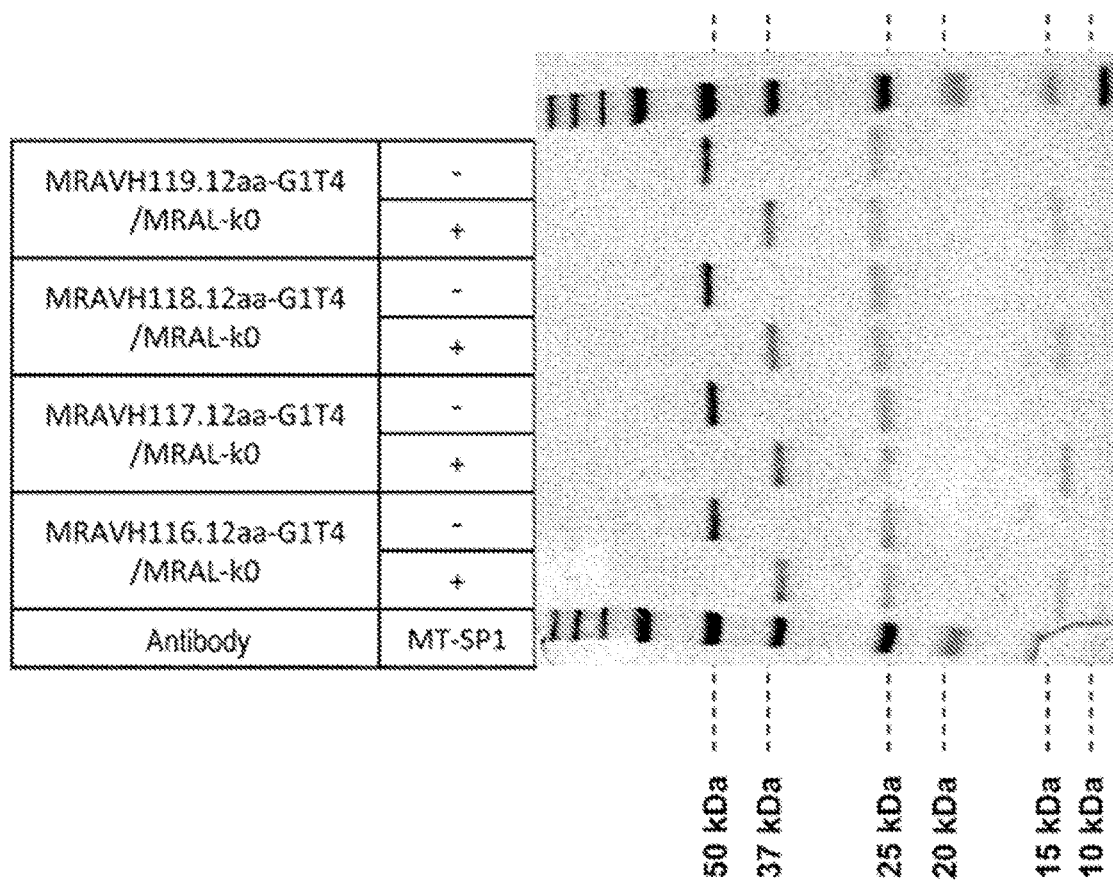
FIG. 31I is a diagram showing results of cleaving engineered MRA antibodies by protease.
Figure 32A:
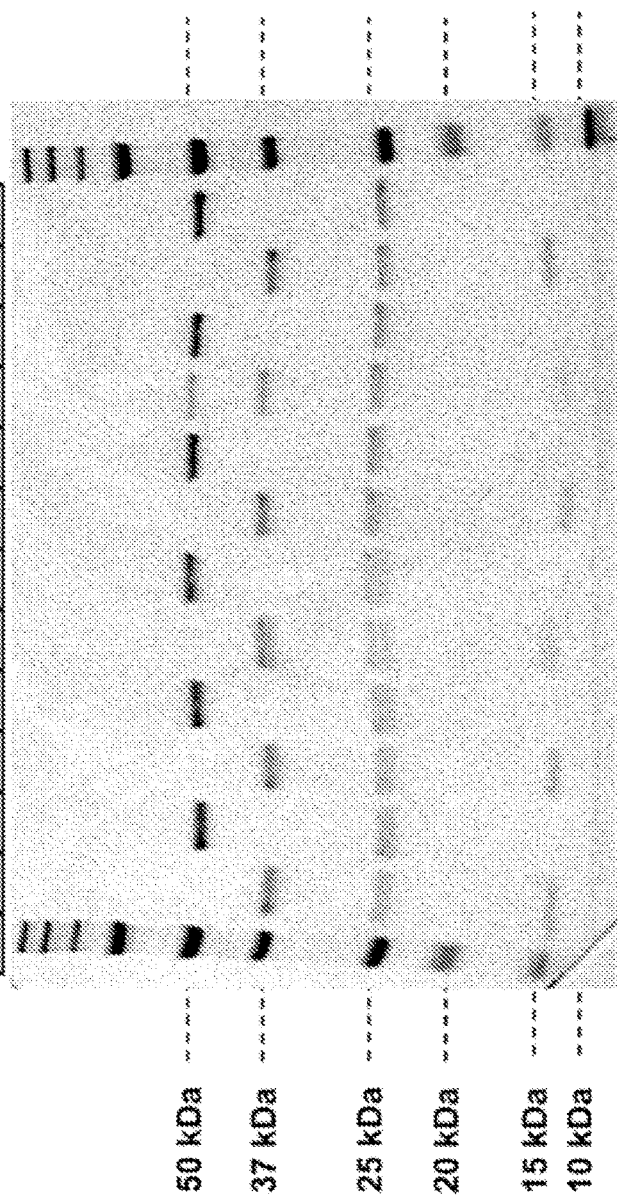
FIG. 32A is a diagram showing results of cleaving engineered MRA antibodies by protease.
Figure 32B:
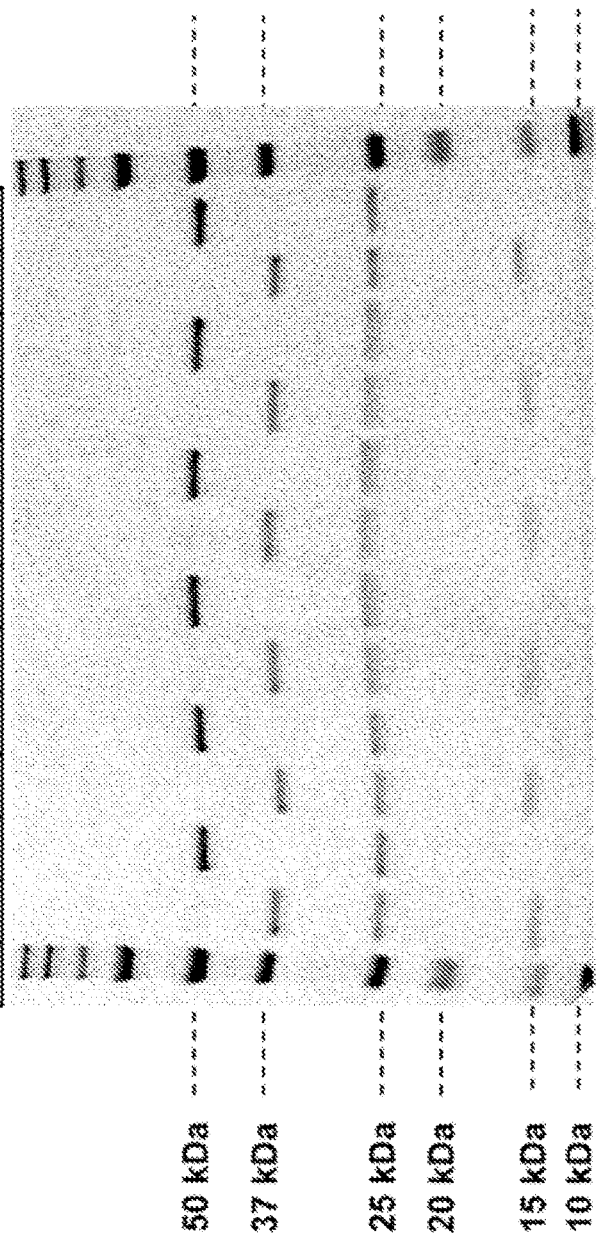
FIG. 32B is a diagram showing results of cleaving engineered MRA antibodies by protease.
Figure 32C:
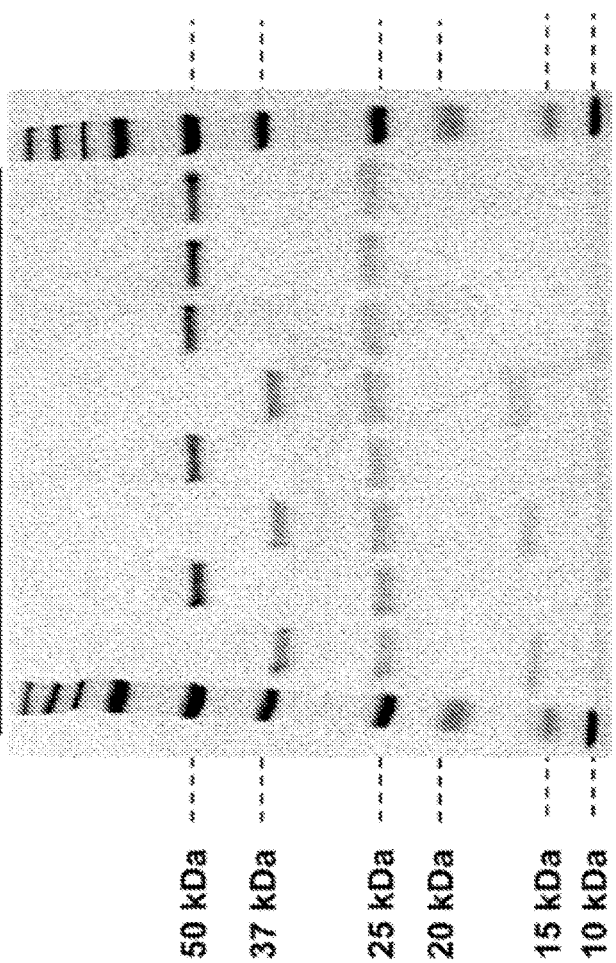
FIG. 32C is a diagram showing results of cleaving engineered MRA antibodies by protease.
Figure 33A:
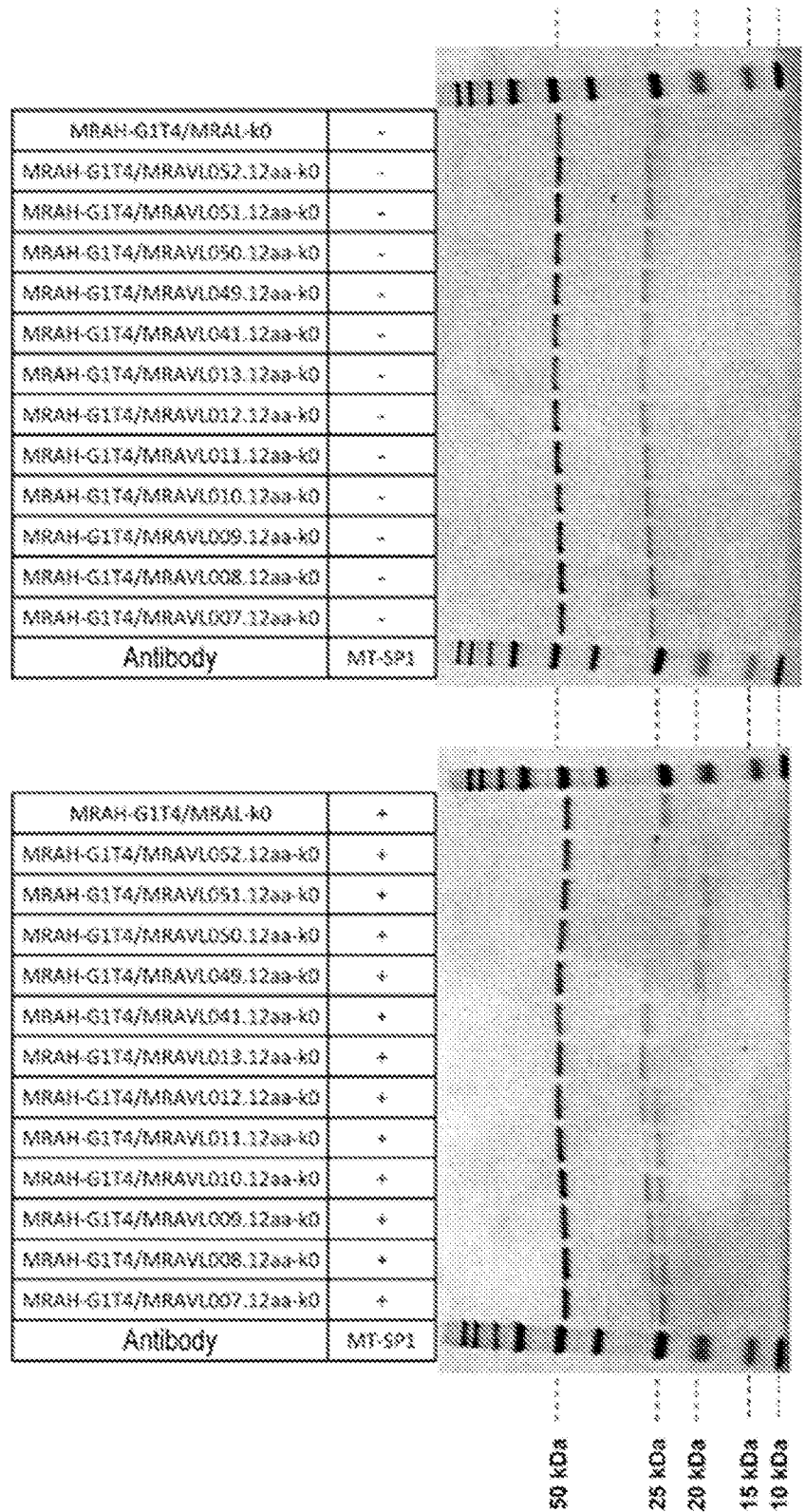
FIG. 33A is a diagram showing results of cleaving engineered MRA antibodies by protease.
Figure 33B:
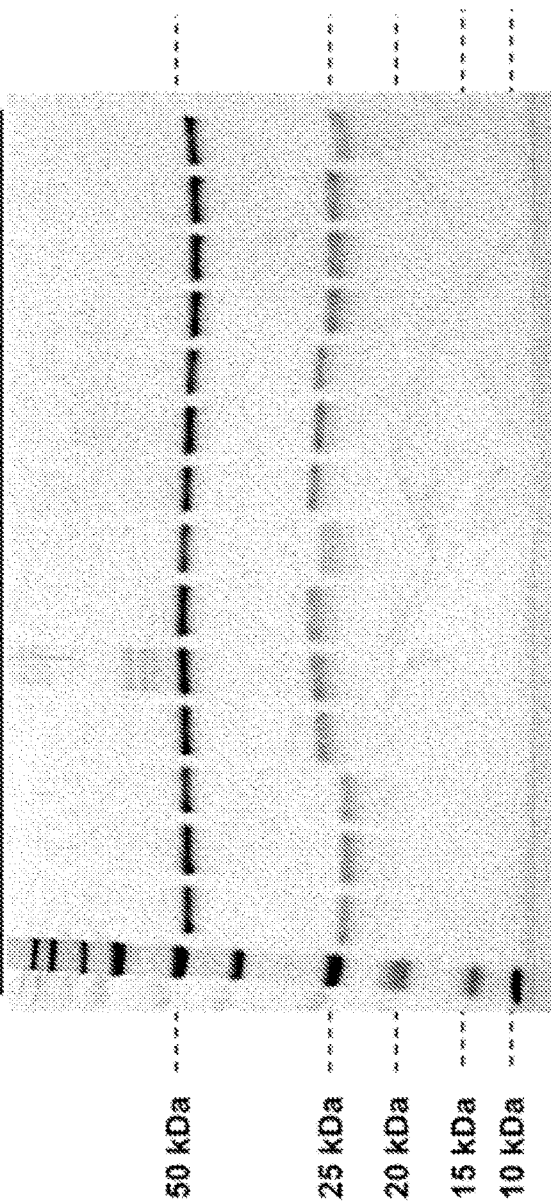
FIG. 33B is a diagram showing results of cleaving engineered MRA antibodies by protease.
Figure 33C:
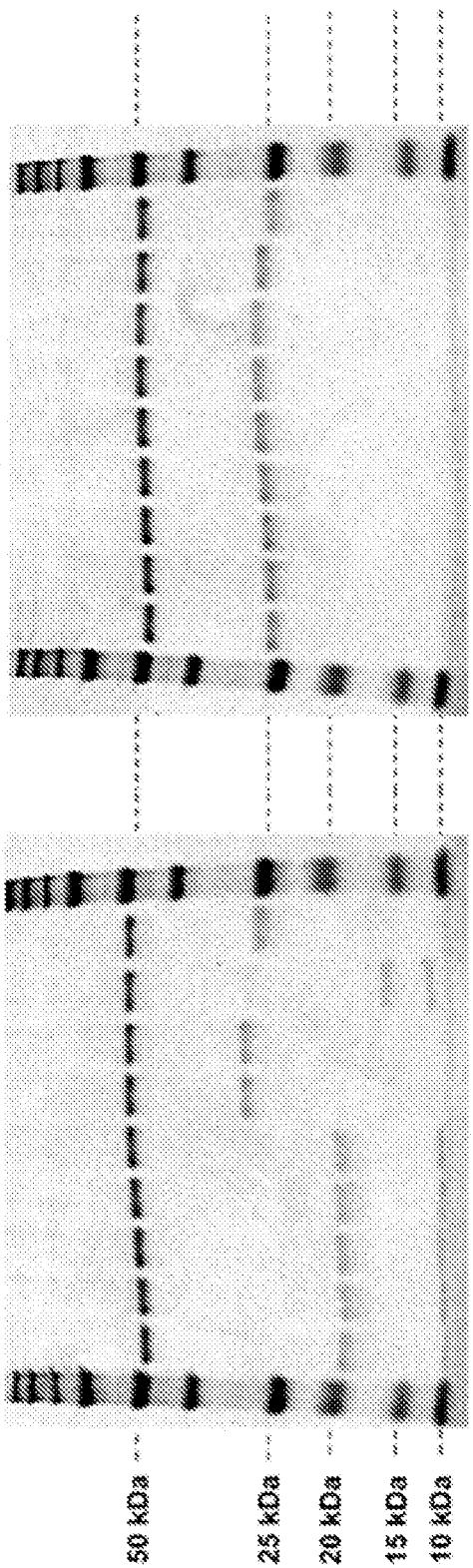
FIG. 33C is a diagram showing results of cleaving engineered MRA antibodies by protease.
Figure 33D:
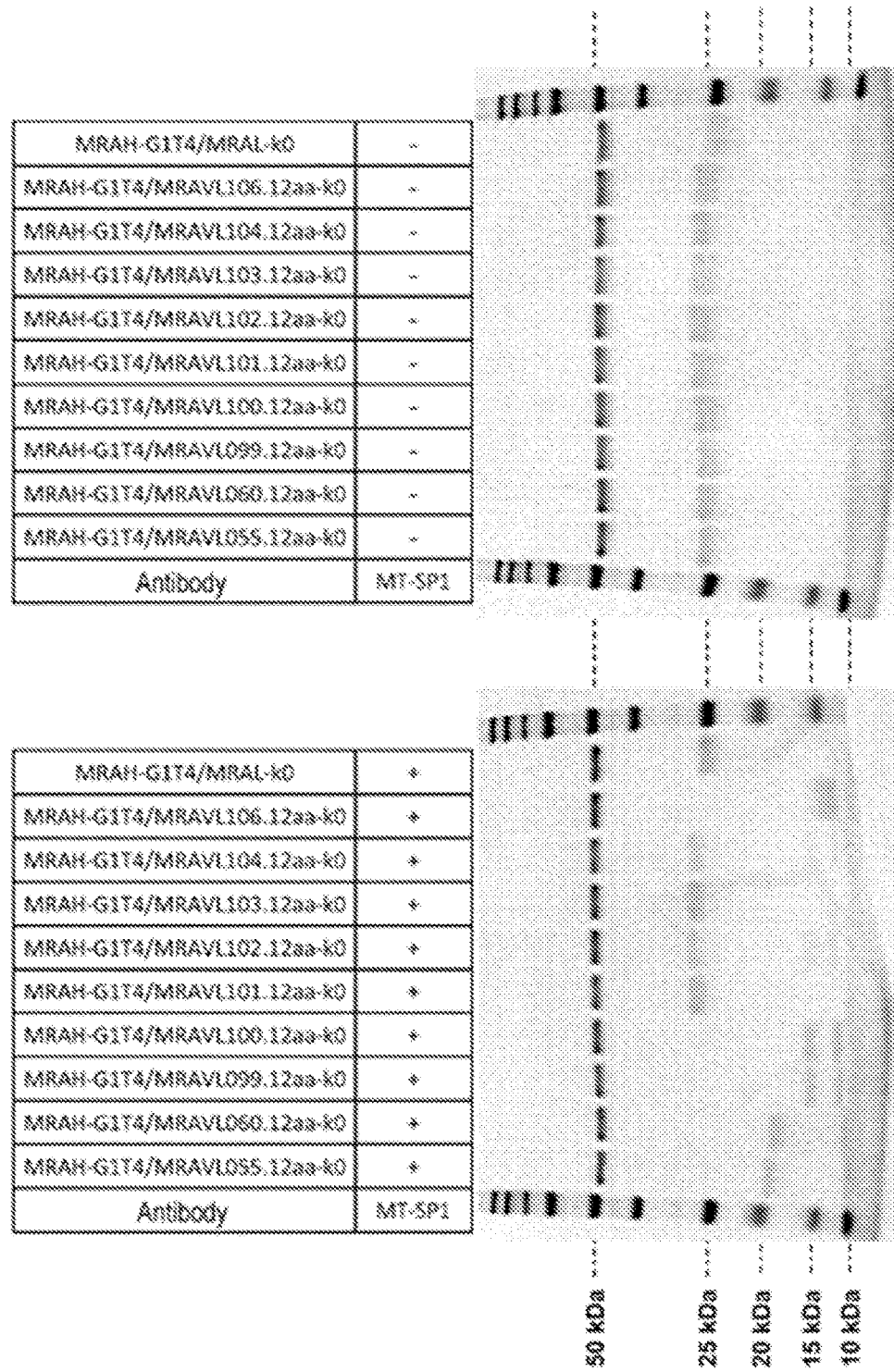
FIG. 33D is a diagram showing results of cleaving engineered MRA antibodies by protease.
Figure 33E:
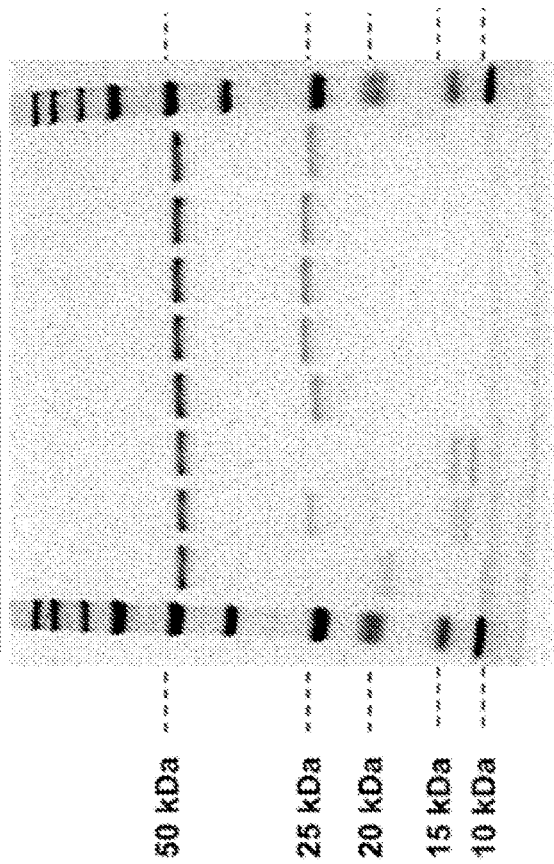
FIG. 33E is a diagram showing results of cleaving engineered MRA antibodies by protease.
Figure 34A:
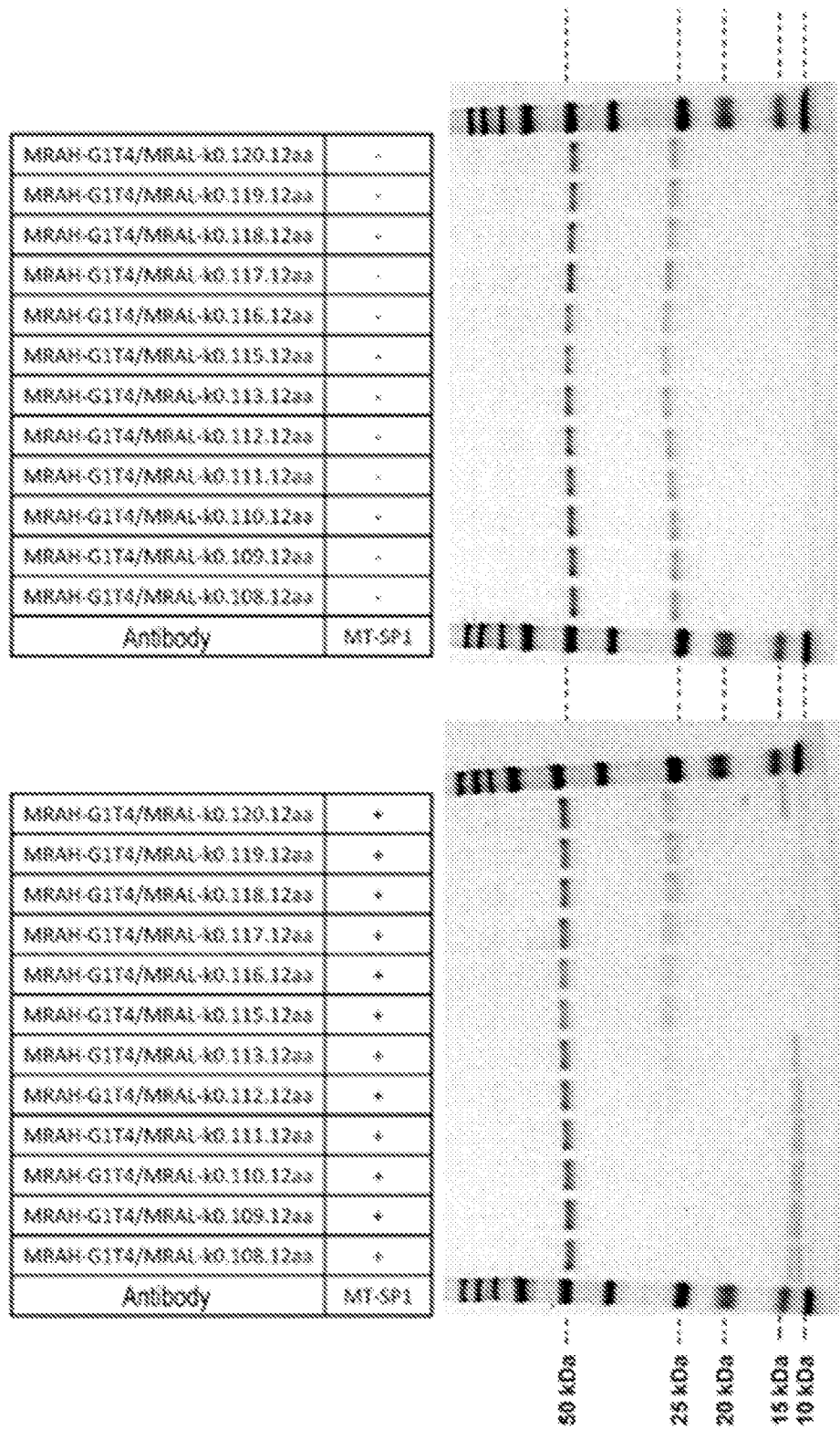
FIG. 34A is a diagram showing results of cleaving engineered MRA antibodies by protease.
Figure 34B:
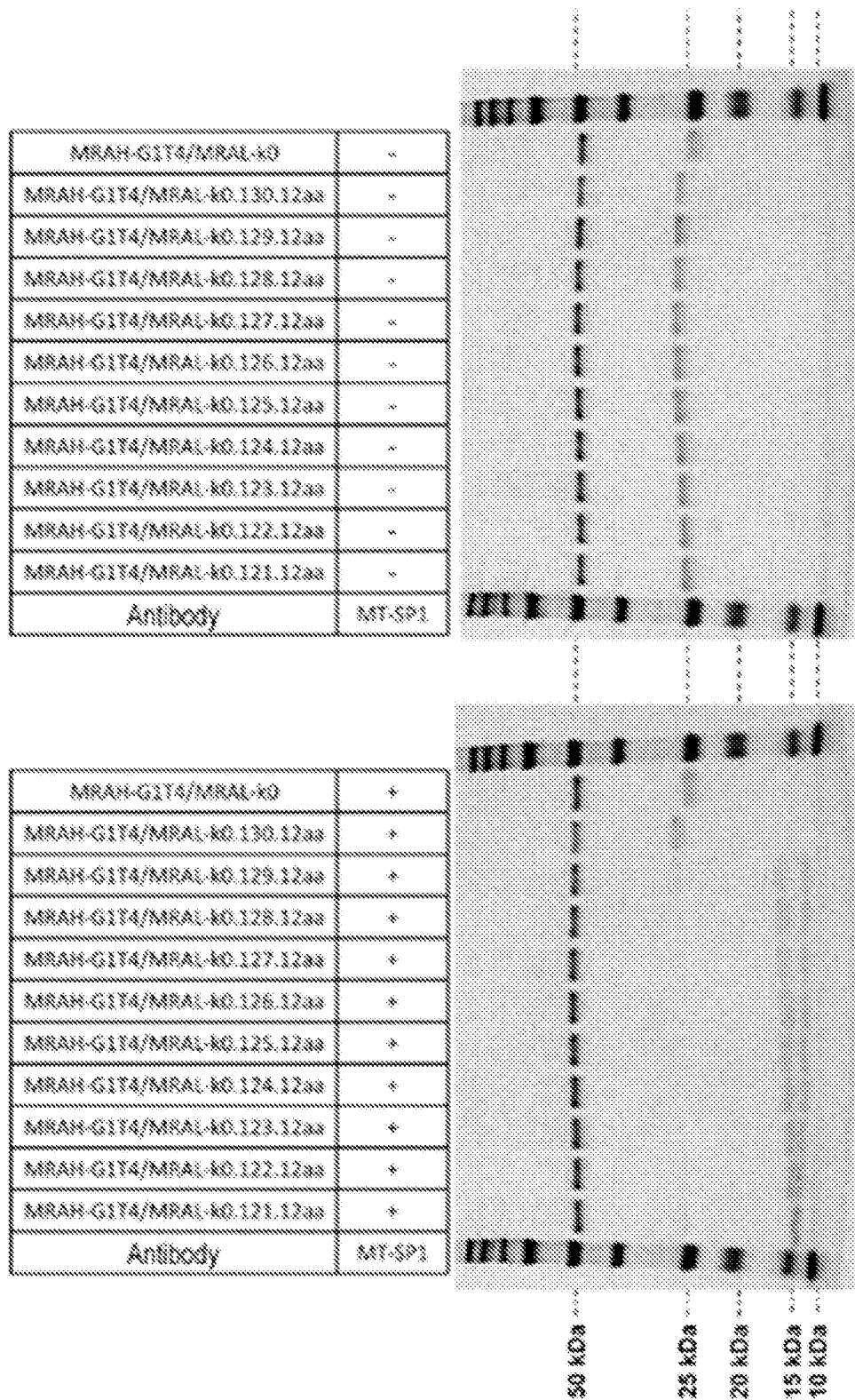
FIG. 34B is a diagram showing results of cleaving engineered MRA antibodies by protease.

13-2 Protease Cleavage Evaluation of IgG Antibody-Like Molecules Harboring Diverse Protease Cleavage Sequences Whether the IgG antibody-like molecules prepared in Example 13-1 would be cleaved by protease was verified. Recombinant human MMP-2 (R&D Systems, Inc., 902-MP-010), recombinant human MMP-7 (R&D Systems, Inc., 907-MP-010), recombinant human MMP-9 (R&D Systems, Inc., 911-MP-010), or recombinant human MMP-13 (R&D Systems, Inc., 511-MM-010) was used as the protease. MMP-2, MMP-7, MMP-9, and MMP-13 were used after being each mixed with 1 MMP-aminophenylmercuric acetate (APMA; Abcam PLC, ab112146) and activated at 37 degrees C. for 1 or 24 hours. 50 nM, 100 nM, or 500 nM protease and 50 micro g/mL or 100 micro g/mL of each IgG-antibody like molecule were reacted in PBS or 20 mM Tris-HCl, 150 mM NaCl, and 5 mM CaCl$_2$) (pH 7.2) (hereinafter, referred to as Tris) under a condition of 37 degrees C. for 20 hours. Then, cleavage by the protease was evaluated by reducing SDS-PAGE. The results are shown in FIGS. 30A and 30B. In FIG. 30B, the protease cleavage was carried out using an assay buffer (MMP Activity Assay Kit (Fluorometric-Green) (ab112146), Component C: Assay Buffer).

As a result, 6R90EIVHEMP2.1-6R90EICHEMP2.1G1m/VK1-39-k0MT, 6R90EIVHEMP2.2-6R90EICHEMP2.2G1m/VK1-39-k0MT, 6R90EIVHEMP2.3-6R90EICHEMP2.3G1m/VK1-39-k0MT, 6R90EIVHEMP2.4-6R90EICHEMP2.4G1m/VK1-39-k0MT, 6R90EIVHEG4SMP2MP9G4S-6R90EICHEG4SMP2MP9G4SG1m/VK1-39-k0MT, and 6R90EIVHEG4SMP2.2G4S-6R90EICHEG4SMP2.2G4SG1m/VK1-39-k0MT were confirmed to be cleaved by MMP-2. 6R90EIVHEMP7.1-6R90EICHEMP7.1G1m/VK1-39-k0MT and 6R90EIVHEMP7.2-6R90EICHEMP7.2G1m/VK1-39-k0MT were confirmed to be cleaved by MMP-7. 6R90EIVHEG4SMP2MP9G4S-6R90EICHEG4SMP2MP9G4SG1m/VK1-39-k0MT and 6R90EIVHEG4SMP9G4S-6R90EICHEG4SMP9G4SG1m/VK1-39-k0MT were confirmed to be cleaved by MMP-9. 6R90EIVHEMP13-6R90EICHEMP13G1m/VK1-39-k0MT was confirmed to be cleaved by MMP-13.

Example 14 Evaluation of Antibodies Harboring Protease Cleavage Sequence at Diverse Positions of Heavy Chain 14-1 Preparation of Antibodies Harboring Protease Cleavage Sequence at Diverse Positions of Heavy Chain Peptide sequence B (SEQ ID NO: 210) reportedly cleavable by urokinase (uPA) and matriptase (MT-SP1) was inserted at each of different positions within a MRA heavy chain variable region (MRAH; SEQ ID NO: 211) to prepare engineered MRA heavy chain variable regions shown in Table 6. These engineered MRA heavy chain variable regions were each linked to a MRA heavy chain constant region (G1T4; SEQ ID NO: 212) to prepare engineered MRA heavy chains. The corresponding gene expression vectors were prepared by a method known to those skilled in the art. Also, peptide sequence B (SEQ ID NO: 210) was inserted at each of different positions within a MRA heavy chain constant region (G1T4; SEQ ID NO: 212) to prepare engineered MRA heavy chain constant regions shown in Table 7. These engineered MRA heavy chain constant regions were each linked to a MRA heavy chain variable region (MRAH; SEQ ID NO: 211) to prepare engineered MRA heavy chains. The corresponding gene expression vectors were prepared by a method known to those skilled in the art. Tables 6 and 7 also show the protease cleavage sequence insertion positions in the prepared engineered MRA heavy chain variable regions and engineered MRA heavy chain constant regions. In Table 6, the inserted sequence was located adjacent on the constant region side to the described position (Kabat numbering) in the antibody heavy chain variable region. In Table 7, the inserted sequence was located adjacent on the variable region side to the described position (EU numbering) in the antibody heavy chain constant region.

TABLE 6

Engineered MRA heavy chain variable regions and protease cleavage sequence insertion positions

| Engineered MRA heavy chain variable region | Protease cleavage sequence insertion position (Kabat numbering) | SEQ ID NO |
|---|---|---|
| MRAVH007.12aa | 7 | 213 |
| MRAVH008.12aa | 8 | 214 |
| MRAVH009.12aa | 9 | 215 |
| MRAVH010.12aa | 10 | 216 |
| MRAVH011.12aa | 11 | 217 |
| MRAVH012.12aa | 12 | 218 |
| MRAVH013.12aa | 13 | 219 |
| MRAVH014.12aa | 14 | 220 |
| MRAVH015.12aa | 15 | 221 |
| MRAVH041.12aa | 40 | 222 |
| MRAVH042.12aa | 41 | 223 |
| MRAVH043.12aa | 42 | 224 |
| MRAVH044.12aa | 43 | 225 |
| MRAVH045.12aa | 44 | 226 |
| MRAVH046.12aa | 45 | 227 |
| MRAVH056.12aa | 55 | 228 |
| MRAVH057.12aa | 56 | 229 |
| MRAVH058.12aa | 57 | 230 |
| MRAVH059.12aa | 58 | 231 |
| MRAVH060.12aa | 59 | 232 |
| MRAVH061.12aa | 60 | 233 |
| MRAVH062.12aa | 61 | 234 |
| MRAVH063.12aa | 62 | 235 |
| MRAVH064.12aa | 63 | 236 |
| MRAVH065.12aa | 64 | 237 |
| MRAVH066.12aa | 65 | 238 |
| MRAVH067.12aa | 66 | 239 |
| MRAVH068.12aa | 67 | 240 |
| MRAVH069.12aa | 68 | 241 |
| MRAVH074.12aa | 73 | 242 |
| MRAVH075.12aa | 74 | 243 |
| MRAVH076.12aa | 75 | 244 |
| MRAVH077.12aa | 76 | 245 |
| MRAVH078.12aa | 77 | 246 |
| MRAVH087.12aa | 83 | 247 |
| MRAVH088.12aa | 84 | 248 |
| MRAVH089.12aa | 85 | 249 |
| MRAVH099.12aa | 95 | 250 |
| MRAVH100.12aa | 96 | 251 |
| MRAVH101.12aa | 97 | 252 |
| MRAVH102.12aa | 98 | 253 |
| MRAVH109.12aa | 103 | 254 |
| MRAVH110.12aa | 104 | 255 |
| MRAVH111.12aa | 105 | 256 |
| MRAVH112.12aa | 106 | 257 |
| MRAVH113.12aa | 107 | 258 |
| MRAVH114.12aa | 108 | 259 |
| MRAVH115.12aa | 109 | 260 |
| MRAVH116.12aa | 110 | 261 |
| MRAVH117.12aa | 111 | 262 |
| MRAVH118.12aa | 112 | 263 |
| MRAVH119.12aa | 113 | 264 |

TABLE 7

Engineered MRA heavy chain constant regions and protease cleavage sequence insertion positions

| Engineered MRA heavy chain constant region | Protease cleavage sequence insertion position (EU numbering) | SEQ ID NO |
|---|---|---|
| G1T4.118.12aa | 119 | 265 |
| G1T4.119.12aa | 120 | 266 |
| G1T4.120.12aa | 121 | 267 |
| G1T4.121.12aa | 122 | 268 |
| G1T4.122.12aa | 123 | 269 |
| G1T4.123.12aa | 124 | 270 |
| G1T4.124.12aa | 125 | 271 |
| G1T4.129.12aa | 130 | 272 |
| G1T4.130.12aa | 131 | 273 |
| G1T4.131.12aa | 132 | 274 |
| G1T4.132.12aa | 133 | 275 |
| G1T4.134.12aa | 135 | 276 |
| G1T4.135.12aa | 136 | 277 |
| G1T4.137.12aa | 138 | 278 |
| G1T4.139.12aa | 140 | 279 |

Engineered MRA antibodies shown in Table 8 were expressed by transient expression using the engineered MRA heavy chains thus prepared in combination with the MRA light chain and using FreeStyle 293 cells (Invitrogen Corp.) or Expi293 cells (Life Technologies Corp.) by a method known to those skilled in the art, and purified by a method known to those skilled in the art using protein A.

TABLE 8

Engineered MRA antibodies

| Antibody name | SEQ ID NO of heavy chain | SEQ ID NO of light chain |
|---|---|---|
| MRAVH007.12aa-G1T4/MRAL-k0 | 347 | 209 |
| MRAVH008.12aa-G1T4/MRAL-k0 | 348 | 209 |
| MRAVH009.12aa-G1T4/MRAL-k0 | 349 | 209 |
| MRAVH010.12aa-G1T4/MRAL-k0 | 350 | 209 |
| MRAVH011.12aa-G1T4/MRAL-k0 | 351 | 209 |
| MRAVH012.12aa-G1T4/MRAL-k0 | 352 | 209 |
| MRAVH013.12aa-G1T4/MRAL-k0 | 353 | 209 |
| MRAVH014.12aa-G1T4/MRAL-k0 | 354 | 209 |
| MRAVH015.12aa-G1T4/MRAL-k0 | 355 | 209 |
| MRAVH041.12aa-G1T4/MRAL-k0 | 356 | 209 |
| MRAVH042.12aa-G1T4/MRAL-k0 | 357 | 209 |
| MRAVH043.12aa-G1T4/MRAL-k0 | 358 | 209 |
| MRAVH044.12aa-G1T4/MRAL-k0 | 359 | 209 |
| MRAVH045.12aa-G1T4/MRAL-k0 | 360 | 209 |
| MRAVH046.12aa-G1T4/MRAL-k0 | 361 | 209 |
| MRAVH056.12aa-G1T4/MRAL-k0 | 362 | 209 |
| MRAVH057.12aa-G1T4/MRAL-k0 | 363 | 209 |
| MRAVH058.12aa-G1T4/MRAL-k0 | 364 | 209 |
| MRAVH059.12aa-G1T4/MRAL-k0 | 365 | 209 |
| MRAVH060.12aa-G1T4/MRAL-k0 | 366 | 209 |
| MRAVH061.12aa-G1T4/MRAL-k0 | 367 | 209 |
| MRAVH062.12aa-G1T4/MRAL-k0 | 368 | 209 |
| MRAVH063.12aa-G1T4/MRAL-k0 | 369 | 209 |
| MRAVH064.12aa-G1T4/MRAL-k0 | 370 | 209 |
| MRAVH065.12aa-G1T4/MRAL-k0 | 371 | 209 |
| MRAVH066.12aa-G1T4/MRAL-k0 | 372 | 209 |
| MRAVH067.12aa-G1T4/MRAL-k0 | 373 | 209 |
| MRAVH068.12aa-G1T4/MRAL-k0 | 374 | 209 |
| MRAVH069.12aa-G1T4/MRAL-k0 | 375 | 209 |
| MRAVH074.12aa-G1T4/MRAL-k0 | 376 | 209 |
| MRAVH075.12aa-G1T4/MRAL-k0 | 377 | 209 |
| MRAVH076.12aa-G1T4/MRAL-k0 | 378 | 209 |
| MRAVH077.12aa-G1T4/MRAL-k0 | 379 | 209 |
| MRAVH078.12aa-G1T4/MRAL-k0 | 380 | 209 |
| MRAVH087.12aa-G1T4/MRAL-k0 | 381 | 209 |
| MRAVH088.12aa-G1T4/MRAL-k0 | 382 | 209 |
| MRAVH089.12aa-G1T4/MRAL-k0 | 383 | 209 |
| MRAVH099.12aa-G1T4/MRAL-k0 | 384 | 209 |
| MRAVH100.12aa-G1T4/MRAL-k0 | 385 | 209 |
| MRAVH101.12aa-G1T4/MRAL-k0 | 386 | 209 |
| MRAVH102.12aa-G1T4/MRAL-k0 | 387 | 209 |
| MRAVH109.12aa-G1T4/MRAL-k0 | 388 | 209 |
| MRAVH110.12aa-G1T4/MRAL-k0 | 389 | 209 |
| MRAVH111.12aa-G1T4/MRAL-k0 | 390 | 209 |
| MRAVH112.12aa-G1T4/MRAL-k0 | 391 | 209 |
| MRAVH113.12aa-G1T4/MRAL-k0 | 392 | 209 |
| MRAVH114.12aa-G1T4/MRAL-k0 | 393 | 209 |
| MRAVH115.12aa-G1T4/MRAL-k0 | 394 | 209 |
| MRAVH116.12aa-G1T4/MRAL-k0 | 395 | 209 |
| MRAVH117.12aa-G1T4/MRAL-k0 | 396 | 209 |
| MRAVH118.12aa-G1T4/MRAL-k0 | 397 | 209 |
| MRAVH119.12aa-G1T4/MRAL-k0 | 398 | 209 |
| MRAH-G1T4.118.12aa/MRAL-k0 | 399 | 209 |
| MRAH-G1T4.119.12aa/MRAL-k0 | 400 | 209 |
| MRAH-G1T4.120.12aa/MRAL-k0 | 401 | 209 |
| MRAH-G1T4.121.12aa/MRAL-k0 | 402 | 209 |
| MRAH-G1T4.122.12aa/MRAL-k0 | 403 | 209 |
| MRAH-G1T4.123.12aa/MRAL-k0 | 404 | 209 |
| MRAH-G1T4.124.12aa/MRAL-k0 | 405 | 209 |
| MRAH-G1T4.129.12aa/MRAL-k0 | 406 | 209 |
| MRAH-G1T4.130.12aa/MRAL-k0 | 407 | 209 |
| MRAH-G1T4.131.12aa/MRAL-k0 | 408 | 209 |
| MRAH-G1T4.132.12aa/MRAL-k0 | 409 | 209 |
| MRAH-G1T4.134.12aa/MRAL-k0 | 410 | 209 |
| MRAH-G1T4.135.12aa/MRAL-k0 | 411 | 209 |
| MRAH-G1T4.137.12aa/MRAL-k0 | 412 | 209 |
| MRAH-G1T4.139.12aa/MRAL-k0 | 413 | 209 |

14-2. Protease Cleavage Evaluation of Anti-Human IL6R Neutralizing Antibody Harboring Protease Cleavage Sequence in its Antibody Heavy Chain Whether the engineered MRA antibodies prepared in Example 14-1 would be cleaved by protease was verified. Recombinant Human Matriptase/ST14 Catalytic Domain (human MT-SP1, hMT-SP1) (R&D Systems, Inc., 3946-SE-010) was used as the protease. 10 nM protease and 50 micro g/mL of each antibody were reacted in PBS under a condition of 37 degrees C. for 20 hours, followed by reducing SDS-PAGE. The results are shown in FIGS. 31A, 31B, 31C, 31D, 31E, 31F, 31G, 31H, 31I, 32A, 32B, and 32C. The protease-treated engineered MRA antibodies underwent cleavage at their heavy chains and generated a heavy chain band at a position with a smaller molecular weight than that of the heavy chains of protease-untreated engineered MRA antibodies (in the drawings, a band appearing around 50 kDa in the MT-SP1(−) lane). From this result, the engineered MRA antibodies prepared in Example 14-1 were confirmed to be cleaved by hMT-SP1.

Example 15 Evaluation of Antibodies Harboring Protease Cleavage Sequence at Diverse Positions of Light Chain 15-1 Preparation of Antibodies Harboring Protease Cleavage Sequence at Diverse Positions of Light Chain Peptide sequence B (SEQ ID NO: 210) reportedly cleavable by urokinase (uPA) and matriptase (MT-SP1) was inserted at each of different positions within a MRA light chain variable region (MRAL; SEQ ID NO: 280) to prepare engineered MRA light chain variable regions shown in Table 9. These engineered MRA light chain variable regions were each linked to a MRA light chain constant region (k0; SEQ ID NO: 281) to prepare engineered MRA light chains. The corresponding gene expression vectors were prepared by a method known to those skilled in the art. Also, peptide sequence B (SEQ ID NO: 210) was inserted at each of different positions within a MRA light chain constant region (k0; SEQ ID NO: 281) to prepare engineered MRA light chain constant regions shown in Table 10. These engineered MRA light chain constant regions were each linked to a MRA light chain variable region (MRAL; SEQ ID NO: 280) to prepare engineered MRA light chains. The corresponding gene expression vectors were prepared by a method known to those skilled in the art. Tables 9 and 10 also show the protease cleavage sequence insertion positions in the prepared engineered MRA light chain variable regions and engineered MRA light chain constant regions. In Table 9, the inserted sequence was located adjacent on the constant region side to the described amino acid position (Kabat numbering) in the antibody light chain variable region. In Table 10, the inserted sequence was located adjacent on the variable region side to the described amino acid position (EU numbering) in the antibody light chain constant region.

TABLE 9

Engineered MRA light chain variable regions and protease cleavage sequence insertion positions

| Engineered MRA light chain variable region | Protease cleavage sequence insertion position (Kabat numbering) | SEQ ID NO |
|---|---|---|
| MRAVL007.12aa | 7 | 282 |
| MRAVL008.12aa | 8 | 283 |
| MRAVL009.12aa | 9 | 284 |
| MRAVL010.12aa | 10 | 285 |
| MRAVL011.12aa | 11 | 286 |
| MRAVL012.12aa | 12 | 287 |
| MRAVL013.12aa | 13 | 288 |
| MRAVL014.12aa | 14 | 289 |
| MRAVL015.12aa | 15 | 290 |
| MRAVL016.12aa | 16 | 291 |
| MRAVL017.12aa | 17 | 292 |
| MRAVL018.12aa | 18 | 293 |
| MRAVL039.12aa | 39 | 294 |
| MRAVL040.12aa | 40 | 295 |
| MRAVL041.12aa | 41 | 296 |
| MRAVL042.12aa | 42 | 297 |
| MRAVL043.12aa | 43 | 298 |
| MRAVL044.12aa | 44 | 299 |
| MRAVL045.12aa | 45 | 300 |
| MRAVL049.12aa | 49 | 301 |
| MRAVL050.12aa | 50 | 302 |
| MRAVL051.12aa | 51 | 303 |
| MRAVL052.12aa | 52 | 304 |
| MRAVL053.12aa | 53 | 305 |
| MRAVL054.12aa | 54 | 306 |
| MRAVL055.12aa | 55 | 307 |
| MRAVL056.12aa | 56 | 308 |
| MRAVL057.12aa | 57 | 309 |
| MRAVL058.12aa | 58 | 310 |
| MRAVL059.12aa | 59 | 311 |
| MRAVL060.12aa | 60 | 312 |
| MRAVL096.12aa | 96 | 313 |
| MRAVL097.12aa | 97 | 314 |
| MRAVL098.12aa | 98 | 315 |
| MRAVL099.12aa | 99 | 316 |
| MRAVL100.12aa | 100 | 317 |
| MRAVL101.12aa | 101 | 318 |
| MRAVL102.12aa | 102 | 319 |
| MRAVL103.12aa | 103 | 320 |
| MRAVL 104.12aa | 104 | 321 |
| MRAVL105.12aa | 105 | 322 |
| MRAVL106.12aa | 106 | 323 |
| MRAVL107.12aa | 107 | 324 |

TABLE 10

Engineered MRA light chain constant regions and protease cleavage sequence insertion positions

| Engineered MRA light chain constant region | Protease cleavage sequence insertion position (EU numbering) | SEQ ID NO |
|---|---|---|
| k0.108.12aa | 109 (Kabat numbering position 109) | 325 |
| k0.109.12aa | 110 (Kabat numbering position 110) | 326 |
| k0.110.12aa | 111 (Kabat numbering position 111) | 327 |
| k0.111.12aa | 112 (Kabat numbering position 112) | 328 |
| k0.112.12aa | 113 (Kabat numbering position 113) | 329 |
| k0.113.12aa | 114 (Kabat numbering position 114) | 330 |
| k0.115.12aa | 116 (Kabat numbering position 116) | 331 |
| k0.116.12aa | 117 (Kabat numbering position 117) | 332 |
| k0.117.12aa | 118 (Kabat numbering position 118) | 333 |
| k0.118.12aa | 119 (Kabat numbering position 119) | 334 |
| k0.119.12aa | 120 (Kabat numbering position 120) | 335 |
| k0.120.12aa | 121 (Kabat numbering position 121) | 336 |
| k0.121.12aa | 122 (Kabat numbering position 122) | 337 |
| k0.122.12aa | 123 (Kabat numbering position 123) | 338 |
| k0.123.12aa | 124 (Kabat numbering position 124) | 339 |
| k0.124.12aa | 125 (Kabat numbering position 125) | 340 |
| k0.125.12aa | 126 (Kabat numbering position 126) | 341 |
| k0.126.12aa | 127 (Kabat numbering position 127) | 342 |
| k0.127.12aa | 128 (Kabat numbering position 128) | 343 |
| k0.128.12aa | 129 (Kabat numbering position 129) | 344 |
| k0.129.12aa | 130 (Kabat numbering position 130) | 345 |
| k0.130.12aa | 131 (Kabat numbering position 131) | 346 |

Engineered MRA antibodies shown in Table 11 were expressed by transient expression using the engineered MRA light chains thus prepared in combination with the MRA heavy chain and using FreeStyle 293 cells (Invitrogen Corp.) or Expi293 cells (Life Technologies Corp.) by a method known to those skilled in the art, and purified by a method known to those skilled in the art using protein A.

TABLE 11

Engineered MRA antibodies

| Antibody name | SEQ ID NO of heavy chain | SEQ ID NO of light chain |
|---|---|---|
| MRAH-G1T4/MRAVL007.12aa-k0 | 208 | 414 |
| MRAH-G1T4/MRAVL008.12aa-k0 | 208 | 415 |
| MRAH-G1T4/MRAVL009.12aa-k0 | 208 | 416 |
| MRAH-G1T4/MRAVL010.12aa-k0 | 208 | 417 |
| MRAH-G1T4/MRAVL011.12aa-k0 | 208 | 418 |
| MRAH-G1T4/MRAVL012.12aa-k0 | 208 | 419 |
| MRAH-G1T4/MRAVL013.12aa-k0 | 208 | 420 |
| MRAH-G1T4/MRAVL014.12aa-k0 | 208 | 421 |
| MRAH-G1T4/MRAVL015.12aa-k0 | 208 | 422 |
| MRAH-G1T4/MRAVL016.12aa-k0 | 208 | 423 |
| MRAH-G1T4/MRAVL017.12aa-k0 | 208 | 424 |
| MRAH-G1T4/MRAVL018.12aa-k0 | 208 | 425 |
| MRAH-G1T4/MRAVL039.12aa-k0 | 208 | 426 |
| MRAH-G1T4/MRAVL040.12aa-k0 | 208 | 427 |
| MRAH-G1T4/MRAVL041.12aa-k0 | 208 | 428 |
| MRAH-G1T4/MRAVL042.12aa-k0 | 208 | 429 |
| MRAH-G1T4/MRAVL043.12aa-k0 | 208 | 430 |
| MRAH-G1T4/MRAVL044.12aa-k0 | 208 | 431 |
| MRAH-G1T4/MRAVL045.12aa-k0 | 208 | 432 |
| MRAH-G1T4/MRAVL049.12aa-k0 | 208 | 433 |
| MRAH-G1T4/MRAVL050.12aa-k0 | 208 | 434 |
| MRAH-G1T4/MRAVL051.12aa-k0 | 208 | 435 |
| MRAH-G1T4/MRAVL052.12aa-k0 | 208 | 436 |
| MRAH-G1T4/MRAVL053.12aa-k0 | 208 | 437 |
| MRAH-G1T4/MRAVL054.12aa-k0 | 208 | 438 |
| MRAH-G1T4/MRAVL055.12aa-k0 | 208 | 439 |
| MRAH-G1T4/MRAVL056.12aa-k0 | 208 | 440 |
| MRAH-G1T4/MRAVL057.12aa-k0 | 208 | 441 |
| MRAH-G1T4/MRAVL058.12aa-k0 | 208 | 442 |
| MRAH-G1T4/MRAVL059.12aa-k0 | 208 | 443 |
| MRAH-G1T4/MRAVL060.12aa-k0 | 208 | 444 |
| MRAH-G1T4/MRAVL096.12aa-k0 | 208 | 445 |
| MRAH-G1T4/MRAVL097.12aa-k0 | 208 | 446 |

TABLE 11-continued

Engineered MRA antibodies

| Antibody name | SEQ ID NO of heavy chain | SEQ ID NO of light chain |
|---|---|---|
| MRAH-G1T4/MRAVL098.12aa-k0 | 208 | 447 |
| MRAH-G1T4/MRAVL099.12aa-k0 | 208 | 448 |
| MRAH-G1T4/MRAVL100.12aa-k0 | 208 | 449 |
| MRAH-G1T4/MRAVL101.12aa-k0 | 208 | 450 |
| MRAH-G1T4/MRAVL102.12aa-k0 | 208 | 451 |
| MRAH-G1T4/MRAVL103.12aa-k0 | 208 | 452 |
| MRAH-G1T4/MRAVL104.12aa-k0 | 208 | 453 |
| MRAH-G1T4/MRAVL105.12aa-k0 | 208 | 454 |
| MRAH-G1T4/MRAVL106.12aa-k0 | 208 | 455 |
| MRAH-G1T4/MRAVL107.12aa-k0 | 208 | 456 |
| MRAH-G1T4/MRAL-k0.108.12aa | 208 | 457 |
| MRAH-G1T4/MRAL-k0.109.12aa | 208 | 458 |
| MRAH-G1T4/MRAL-k0.110.12aa | 208 | 459 |
| MRAH-G1T4/MRAL-k0.111.12aa | 208 | 460 |
| MRAH-G1T4/MRAL-k0.112.12aa | 208 | 461 |
| MRAH-G1T4/MRAL-k0.113.12aa | 208 | 462 |
| MRAH-G1T4/MRAL-k0.115.12aa | 208 | 463 |
| MRAH-G1T4/MRAL-k0.116.12aa | 208 | 464 |
| MRAH-G1T4/MRAL-k0.117.12aa | 208 | 465 |
| MRAH-G1T4/MRAL-k0.118.12aa | 208 | 466 |
| MRAH-G1T4/MRAL-k0.119.12aa | 208 | 467 |
| MRAH-G1T4/MRAL-k0.120.12aa | 208 | 468 |
| MRAH-G1T4/MRAL-k0.121.12aa | 208 | 469 |
| MRAH-G1T4/MRAL-k0.122.12aa | 208 | 470 |
| MRAH-G1T4/MRAL-k0.123.12aa | 208 | 471 |
| MRAH-G1T4/MRAL-k0.124.12aa | 208 | 472 |
| MRAH-G1T4/MRAL-k0.125.12aa | 208 | 473 |
| MRAH-G1T4/MRAL-k0.126.12aa | 208 | 474 |
| MRAH-G1T4/MRAL-k0.127.12aa | 208 | 475 |
| MRAH-G1T4/MRAL-k0.128.12aa | 208 | 476 |
| MRAH-G1T4/MRAL-k0.129.12aa | 208 | 477 |
| MRAH-G1T4/MRAL-k0.130.12aa | 208 | 478 |

15-2. Protease Cleavage Evaluation of Anti-Human IL6R Neutralizing Antibody Harboring Protease Cleavage Sequence in its Antibody Light Chain Variable Region Whether the engineered MRA antibodies prepared in Example 15-1 would be cleaved by protease was verified. Recombinant Human Matriptase/ST14 Catalytic Domain (MT-SP1) (R&D Systems, Inc., 3946-SE-010) was used as the protease. 10 nM protease and 50 micro g/mL of each antibody were reacted in PBS under a condition of 37 degrees C. for 20 hours, followed by reducing SDS-PAGE. The results are shown in FIGS. 33A, 33B, 33C, 33D, 33E, 34A, and 34B. The protease-treated engineered MRA antibodies underwent cleavage at their light chains and generated a light chain band at a position with a smaller molecular weight than that of the light chains of protease-untreated engineered MRA antibodies (in the drawings, a band appearing around 25 kDa in the MT-SP1(−) lane).

Example 16 Immunization Against Alpaca

Alpacas were immunized subcutaneous with mixture of KLH conjugated Aggrecan peptides (hAg2KL, hAg3KL, oAg2KL and hAg3KL). One hundred microgram of each peptides were administered together with a Freund's complete adjuvant at week 0. Then one hundred microgram of each peptides were administered together with a Freund's incomplete adjuvant total four times every other week. Five, seven or nine weeks later from first administration of antigens, PBMCs was isolated from peripheral blood. The sequences of peptides were shown in Table 12.

TABLE 12

Peptides for immunization

| Peptide | Peptide sequence | modification | Source |
|---|---|---|---|
| hAg2KL | WPDMELPLPRNITEGEARGSV (SEQ ID NO: 479) | KLH modification (—NH2 of N terminal) | Human aggrecan |
| hAg3KL | ITEGEARGSVILTVKPIFEVSPC (SEQ ID NO: 507) | KLH modification on Cys | Human aggrecan |
| oAg2KL | WPDVELPVPRNITEGEARGSV (SEQ ID NO: 481) | KLH modification (—NH2 of N terminal) | Rabbit aggrecan |
| oAg3KL | ITEGEARGSVVLTAKPVLDVSPC (SEQ ID NO: 508) | KLH modification on Cys | Rabbit aggrecan |

Example 17 Identification of Anti-Aggrecan Antibodies by Phage Display 17-1 Antigens for Panning The peptides for panning were synthetized and modified by biotin described in Table 13. Human aggrecan G1-IGD-G2 domain with Flag-tag was labelled with NHS-PEG4-Biotin according to the manufactures protocol (ThermoSCIENTIFIC, Cat No. 21329).

TABLE 13

Peptides for panning

| Peptide | Peptide sequence | modification | Source |
|---|---|---|---|
| hAg2bi | WPDMELPLPRNITEGEARGSV (SEQ ID NO: 479) | N terminal biotin modification | Human aggrecan |
| hAg3bi | ITEGEARGSVILTVKPIFEVSP (SEQ ID NO: 480) | N terminal biotin modification | Human aggrecan |

TABLE 13-continued

Peptides for panning

| Peptide | Peptide sequence | modification | Source |
|---|---|---|---|
| oAg2bi | WPDVELPVPRNITEGEARGSV (SEQ ID NO: 481) | N terminal biotin modification | Rabbit aggrecan |
| oAg3bi | ITEGEARGSVVLTAKPVLDVSP (SEQ ID NO: 482) | N terminal biotin modification | Rabbit aggrecan |

17-2 Phage Display Construction and Panning

VHH cDNA from alpaca was recovered from collected PBMC according to the previous method described in J.Immunol Methods (2017)324,13. The amplified VHH cDNA fragment was inserted into a phagemid vector and connected with gene 3 protein for phage display. The constructed phagemids were transferred into E. coli by electroporation to prepare E. coli harboring the VHH library fragment.

Phages were produced from the E. coli harboring the constructed phagemids for phage display by method known to those skilled in the art. After infection helper phage and incubation 2.5 M NaCl/10% PEG was added to the culture supernatant of the E. coli that had produced phages, and a pool of the phages thus precipitated was diluted with TBS to obtain a phage library solution.

Next, BSA (final concentration: 4%) was added to the phage library solution. The panning method was performed with reference to a general panning method using antigens immobilized on magnetic beads (J. Immunol. Methods. (2008) 332 (1-2), 2-9; J. Immunol. Methods. (2001) 247 (1-2), 191-203; Biotechnol. Prog. (2002) 18 (2) 212-20; and Mol. Cell Proteomics (2003) 2 (2), 61-9). The magnetic beads used were NeutrAvidin coated beads (HM-NeutrAvidin beads, TAMAGAWA SEIKI CO.,LTD, TAB8848N3171) or Streptavidin coated beads (Dynabeads MyOne Streptavidin T1, Invitrogen, 65602). Specifically, 100 pmol of the biotin-labeled Human aggrecan G1-IGD-G2 domain with Flag-tag or biotin-rabbit aggrecan G1-IGD-G2-3xFlag was added to the prepared phage library solution and thereby contacted with the phage library solution at room temperature for 60 minutes. After addition of BSA-blocked magnetic beads, the antigen-phage complexes were attached to the magnetic beads at room temperature for 15 minutes. For peptide antigens 500pmol of peptide mixture was added onto the BSA-blocked magnetic beads solution for 30 minutes. The peptide attached beads were washed three times with TBST (TBS containing 0.1% Tween20) and then contacted with the phage library solution at room temperature for 60 minutes. After antigen-phage contact, the beads were washed three times with TBST (TBS containing 0.1% Tween 20; TBS was available from Takara Bio Inc.) and then further washed twice with 1 mL of TBS. After addition of 5 microL of 100 microg/mL trypsin, the beads were suspended at room temperature for 15 minutes, immediately after which the beads were separated using a magnetic stand to recover a phage solution. The recovered phage solution was added to 10 mL of an E. coli strain ER2738 in a logarithmic growth phase (OD600: 0.4-0.5). The E. coli strain was infected by the phages through the gentle spinner culture of the strain at 37 degrees C. for 1 hour. The infected E. coli was inoculated to a plate of 225 mm×225 mm. Next, phages were recovered from the culture solution of the inoculated E. coli to prepare a phage library solution. The panning against antigens was repeated several times. The sequences of enriched clones were analyzed by the method of those skilled in art and antigen binding of the clones were analyzed by VHH displayed on phage as follows;

A phage-containing culture supernatant was recovered according to a routine method (Methods Mol. Biol. (2002) 178, 133-145) from each single colony of the E. coli obtained by the method described above and subjected to ELISA by the following procedures:

384 well plate clear w/o lid maxisorp non-sterile PS (Thermo Scientific, 464718) was coated overnight at 4 degrees C. with 20 micro L of 2.5 micro g/mL of Streptavidin (Thermo SCIENTIFIC, 21125). Each well of the plate was washed with TBST (TBS containing 0.1% Tween20) to remove excess amount of Streptavidin. The Streptavidin coated plate or MICROPLATE, 384 WELL, PS, F-BOTTOM, CLEAR, STREPTAVIDIN-COATED, 5 PCS./BAG (greiner bio-one, Item No.: 781990) was coated overnight at 4 degrees C. or at room temperature for 1 hour with 10 micro L of the biotin-labeled antigen (hAg2bi, hAg3bi, oAg2bi, oAg3bi, biotin-labeled Human aggrecan G1-IGD-G2 domain with Flag-tag or biotin-rabbit aggrecan G1-IGD-G2-3xFlag) or PBS as non-coating control. Each well of the plate was washed with TBST to remove unbound antigens. Then, the well was blocked with 80 micro L of 2% Skim milk in TBS for 1 hour or longer. After removal of 2% Skim milk in TBS, the prepared culture supernatant was added to each well, and the plate was left standing at room temperature for 1 hour so that the phage-displayed VHH bound to the antigen contained in each well. Each well was washed with TBST, and HRP-conjugated anti-M13 antibodies (GE Healthcare, 27-9421-01) diluted with TBS containing Skim milk (final concentration: 2%) were then added to each well. The plate was incubated for 1 hour. After washing with TBST, TMB single solution (ZYMED Laboratories, Inc.) was added to the well. The chromogenic reaction of the solution in each well was terminated by the addition of sulfuric acid. Then, the developed color was assayed on the basis of absorbance at 450 nm.

The binding against native rabbit aggrecan was determined by ELISA. 384 well plate clear w/o lid maxisorp non-sterile PS (Thermo Scientific, 464718) was coated overnight at 4 degrees C. with 10 micro L of 25pmol/mL of native rabbit aggrecan or PBS as non-coating control. Each well of the plate was washed with TBST (TBS containing 0.1% Tween20) to remove unbound antigens. Then, the well was blocked with 80 micro L of 2% Skim milk in TBS for 1 hour or longer. After removal of 2% Skim milk in TBS, the prepared culture supernatant was added to each well, and the plate was left standing at room temperature for 1 hour so that the phage-displayed VHH bound to the antigen contained in each well. Each well was washed with TBST, and HRP-conjugated anti-M13 antibodies (GE Healthcare, 27-9421-01) diluted with TBS containing Skim milk (final concentration: 2%) were then added to each well. The plate was incubated for 1 hour. After washing with TBST, TMB single solution (ZYMED Laboratories, Inc.) was added to the well. The chromogenic reaction of the solution in each well was terminated by the addition of sulfuric acid. Then, the developed color was assayed on the basis of absorbance at 450 nm.

The S/N ratio was calculated as follows;

S/N=(450 nm Absorbance of antigen coating well)/
(450 nm Absorbance of non-coating control well)

Figure 35:
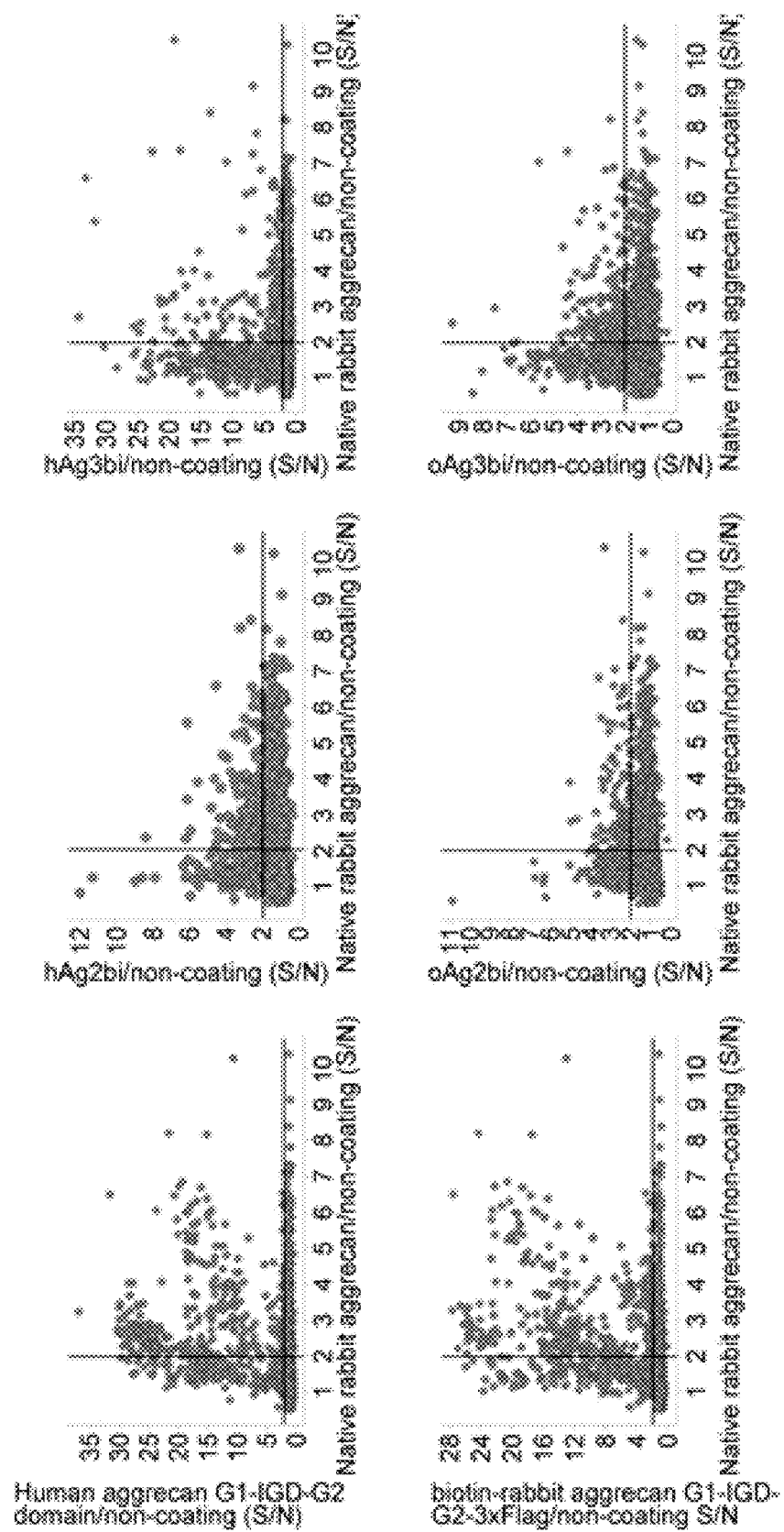
FIG. 35 is a diagram showing the binding of VHH displayed by phage to antigens

The results are shown in FIG. 35. As shown in the FIG. 35, phage displayed antibodies bound to human recombinant aggrecan, rabbit recombinant aggrecan, rabbit native aggrecan and/or peptides. Clones exhibiting binding activity can be selected from a further increased number of library members to be evaluated.

17-3 Antigen Binding of Anti-Aggrecan Antibody

The VHH cDNA or cDNA pool selected from Example 17-2 was cloned into mammalian cell expression vector fused with heavy chain constant region (Fc region) and evaluated its binding activity against antigens. The VHH with Fc region shown in the Table 14 was expressed by Expi293 cell by method those skilled in the art. The antigen binding was evaluated by ELISA.

TABLE 14 anti-Aggrecan VHH with Fc region

| Heavy chain variable region (VHH) | Fc region | Heavy chain variable region (SEQ ID NO) | Fc region (SEQ ID NO) |
|---|---|---|---|
| hA2R1p.004 | G1T3dCH1dCallohu | 499 | 506 |
| oA2R1p.014 | G1T3dCH1dCallohu | 500 | 506 |
| hA2R3p.038 | G1T3dCH1dCallohu | 501 | 506 |
| oA2R2#0031 | G1T3dCH1dC | 503 | 491 |
| oA2R2#027un | G1T3dCH1dC | 504 | 491 |
| oA2R2#041un | G1T3dCH1dC | 505 | 491 |

MICROPLATE, 384 WELL, PS, F-BOTTOM, CLEAR, STREPTAVIDIN-COATED, 5 PCS./BAG (greiner bio-one, Item No.: 781990) was coated at room temperature for more than 1 hour with 10 micro L of the biotin-labeled antigen (hAg2bi, hAg3bi, oAg2bi, oAg3bi, biotin-labeled Human aggrecan G1-IGD-G2 domain with Flag-tag or biotin-rabbit aggrecan G1-IGD-G2-3xFlag) or PBS as non-coating control. Each well of the plate was washed with TBST (TBS containing 0.1% Tween20) to remove unbound antigens. Then, the well was blocked with 80 micro L of Blocking buffer (TBS containing 0.1% Tween20, 0.5% BSA and Block ACE) for 1 hour or longer. After removal of Blocking buffer, VHH with human Fc region was added to each well, and the plate was left standing at room temperature for 1 hour or longer so that VHH with human Fc region binds to the antigen contained in each well. Each well was washed with TBST, and then HRP-conjugated Goat anti-human IgG antibody (Invitrogen, AHI0304) diluted with Blocking buffer were added to each well. The plate was incubated for 1 hour. After washing with TBST, TMB single solution (ZYMED Laboratories, Inc.) was added to the well. The chromogenic reaction of the solution in each well was terminated by the addition of sulfuric acid. Then, the developed color was assayed on the basis of absorbance at 450 nm.

The binding against native rabbit aggrecan was determined by ELISA. 384 well plate clear w/o lid maxisorp non-sterile PS (Thermo Scientific, 464718) was coated overnight at 4 degrees C. with 10 micro L of 10 nM of native rabbit aggrecan or PBS as non-coating control. Each well of the plate was washed with TBST (TBS containing 0.1% Tween20) to remove unbound antigens. Then, the well was blocked with 80 micro L of Blocking buffer (TBS containing 0.1% Tween20, 0.5% BSA and Block ACE) in TBS for 1 hour or longer. After removal of Blocking Buffer, VHH with human Fc region was added to each well, and the plate was left standing at room temperature for 1 hour or longer so that VHH with human Fc region binds to the antigen contained in each well. Each well was washed with TBST, and HRP-conjugated Goat anti-human IgG antibody (Invitrogen, AHI0304) diluted with Blocking buffer were then added to each well. The plate was incubated for 1 hour. After washing with TBST, TMB single solution (ZYMED Laboratories, Inc.) was added to the well. The chromogenic reaction of the solution in each well was terminated by the addition of sulfuric acid. Then, the developed color was assayed on the basis of absorbance at 450 nm.

The S/N ratio was calculated as follows;

S/N=(450 nm Absorbance of antigen coating well)/
(450 nm Absorbance of non-coating control well)

The ELISA result is shown in the Table 15 below. When the S/N ratio of antibody is more than 2, the clone is thought to be an antigen binder in this assay. From the ELISA result antibodies having human aggrecan and/or rabbit aggrecan could be identified.

TABLE 15

ELISA result of obtained clones

| Heavy chain variable region | Fc region | biotin-labeled Human aggrecan G1-IGD-G2 domain with Flag-tag (S/N ratio) | biotin-rabbit aggrecan G1-IGD-G2-3xFlag (S/N ratio) | Native rabbit aggrecan (S/N ratio) |
|---|---|---|---|---|
| hA2R1p.004 | G1T3dCH1dCallohu | 42.7 | 52.5 | 0.99 |
| oA2R1p.014 | G1T3dCH1dCallohu | 47.6 | 52.9 | 1.12 |
| hA2R3p.038 | G1T3dCH1dCallohu | 29.9 | 4.5 | 0.91 |
| oA2R2#027un | G1T3dCH1dC | 33.0 | 37.8 | 2.39 |
| oA2R2#041un | G1T3dCH1dC | 29.9 | 34.3 | 5.17 |

The binding affinity of the antibodies at pH 7.4 was confirmed at 25 degrees C. using Biacore T200 instrument (GE Healthcare). Recombinant Protein G (CALBIOCHEM) was immobilized onto all flow cells of a CM3 sensor chip using amine coupling kit (GE Healthcare). Antibodies and analytes are prepared in buffer (20 mM ACES, 150 mM NaCl, 0.05% Tween 20, pH 7.4). Each antibody was captured onto the sensor surface by protein G. Each analytes of human G1G2 was injected at 0 nM and 500 nM, followed by dissociation. Sensor surface was regenerated each cycle with 25 mM NaOH and 10 mM Glycine-HCl pH 1.5.

Example 18: Immunogen Preparation

Chimeric aggrecan G1(mouse)-IGD(rabbit)-G2(mouse) domain with Fc-tag on its C-terminus (chimeric aggrecan G1-IGD-G2-Fc) (SEQ ID NO: 530) was expressed transiently using FreeStyle293F cell line (Thermo Fisher). Conditioned media expressing chimeric aggrecan G1-IGD-G2-Fc was purified using a HiTrap MabSelect SuRe column (GE healthcare). Fractions containing chimeric aggrecan G1-IGD-G2-Fc were collected and subsequently subjected to a Superdex 200 gel filtration column (GE healthcare) equilibrated with 1x D-PBS. Fractions containing chimeric aggrecan G1-IGD-G2-Fc were then pooled and stored at −80 degrees C.

Rabbit aggrecan IGD domain with Fc-tag on its C-terminus (rabbit aggrecan IGD-Fc) (SEQ ID NO: 532) and rabbit aggrecan G1-IGD-G2 domain with Fc tag (rabbit aggrecan G1-IGD-G2-Fc) (SEQ ID NO: 531) were expressed and purified using the same method as chimeric aggrecan G1-IGD-G2-Fc.

Human aggrecan G1-IGD-G2 domain with Flag-tag on its C-terminus (human aggrecan G1-IGD-G2-Flag, human Aggrecan G1G2 flag, human G1G2) (SEQ ID NO: 534) was expressed transiently using FreeStyle293F cell line (Thermo Fisher). Conditioned media expressing human aggrecan G1-IGD-G2-Flag was applied to a HiTrap Q HP column (GE healthcare). Fractions containing human aggrecan G1-IGD-G2-Flag were collected and subsequently subjected to a Superdex 200 gel filtration column (GE healthcare) equilibrated with 1x D-PBS. Fractions containing human aggrecan G1-IGD-G2-Flag were then pooled and stored at −80 degrees C.

Cartilage tissue of rabbit knee, femoral head, elbow and shoulder was harvested, minced into small pieces and mixed with extraction buffer [4M Guanidine-HCl, 50 mM Tris-HCl, pH 8.0, 10 mM EDTA, 10 mM NEM, 1 mM PMSF and cOmplete™ protease inhibitor cocktail (Roche)]. Native rabbit aggrecan was extracted by repeating freezing/thawing for three times followed by agitation for overnight at 4 degrees C. The mixture was then centrifuged and supernatant containing native aggrecan was collected and stored at −80 degrees C.

Rabbit aggrecan G1-IGD-G2 domain with three tandem Flag-tag on its C-terminus and Avi-tag on its N-terminus (SEQ ID NO: 535) was expressed transiently using FreeStyle293F cell line (Thermo Fisher). BirA enzyme (SEQ ID NO: 539) was co-expressed in the presence of 0.1 mM biotin in the cell culture media for in vivo biotinylation of the Avi-tag. Conditioned media expressing biotin-rabbit aggrecan G1-IGD-G2-3xFlag (biotinylated Avi-rabbit aggrecan G1-IGD-G2-3XFLAG, Avi RbG1G2 3FLAG, rabbit aggrecan Avi RbG1G2 3Flag, biotin-rabbit aggrecan G1-IGD-G2-3xFlag, Avi-rabbit aggrecan G1-IGD-G2-3XFLAG) was applied to a HiTrap Q HP column (GE healthcare). Fractions containing biotin-rabbit aggrecan G1-IGD-G2-3xFlag were collected and subsequently subjected to a Superdex 200 gel filtration column (GE healthcare) equilibrated with 1x D-PBS. Fractions containing biotin-rabbit aggrecan G1-IGD-G2-3xFlag were then pooled and stored at −80 degrees C.

Rabbit aggrecan G1-IGD-G2 domain with C-terminal single Flag-tag (rabbit aggrecan G1-IGD-G2-FLAG) (SEQ ID NO: 533) was expressed transiently using FreeStyle293F cell line (Thermo Fisher). Conditioned media expressing Rabbit aggrecan G1-IGD-G2 domain with C-terminal single Flag-tag was applied to a column packed with anti-Flag M2 affinity resin (Sigma) and eluted with Flag peptide (Sigma). Fractions containing Rabbit aggrecan G1-IGD-G2 domain with C-terminal single Flag-tag were collected and subsequently subjected to a HiTrap Q HP column (GE healthcare). Fractions containing Rabbit aggrecan G1-IGD-G2 domain with C-terminal single Flag-tag were collected and subsequently subjected to a Superdex 200 gel filtration column (GE healthcare) equilibrated with 1x D-PBS. Fractions containing Rabbit aggrecan G1-IGD-G2 domain with C-terminal single Flag-tag were then pooled and stored at −80 degrees C.

Example 19: Generation of Anti-Aggrecan Antibody

Generation of anti-aggrecan antibody were carried out in rabbit and mouse with different immunogens as described below.

19.1: Rabbit Immunization with Recombinant Aggrecan Protein

Three NZW rabbits were first immunized intradermally with 100 micro g of recombinant rabbit G1-IGD-G2-Fc. Two weeks after the initial immunization, five more weekly doses of the same immunogen were given (50 micro g/dose/rabbit). One week after the final immunization, spleen and blood from immunized rabbits were collected. For B cell sorting, antigen-specific B-cells were stained with rabbit aggrecan G1-IGD-G2-FLAG, Avi-rabbit aggrecan G1-IGD-G2-3XFLAG or rabbit aggrecan IGD-Fc (biotinylated or Alexa Fluor 488 labeled), non-specific Fc binding B-cells were eliminated by staining with Fc conjugated irrelevant proteins. Sorted B cells were plated and cultured as described in WO2016098356A1. After 7-12 days culturing, B-cell culture supernatants were collected for further analysis and cell pellets were cryopreserved.

19.2: Rabbit Immunization with Synthetic Aggrecan Peptides

Three NZW rabbits were first immunized intradermally with 100 micro g of KLH-conjugated rabbit aggrecan peptide mixture (equal amount of peptide 1-4 mixed together, Table 16, GenScript). Two weeks after the initial immunization, five more weekly doses of the same immunogen were given (50 micro g/dose/rabbit). One week after the final immunization, spleen and blood from immunized rabbits were collected. Antigen-specific B-cells were stained with biotinylated Avi-rabbit aggrecan G1-IGD-G2-3XFLAG and sorted with FCM cell sorter (FACS aria III, BD). Sorted B cells were plated and cultured as described above. After 7-12 days culturing, B-cell culture supernatants were collected for further analysis and cell pellets were cryopreserved.

TABLE 16

| | amino acid sequence |
|---|---|
| peptide 1 | CEEDITVQTVTWPDVELPVPR (SEQ ID NO: 495) |
| peptide 2 | CWPDVELPVPRNITEGEARGS (SEQ ID NO: 496) |
| peptide 3 | CNITEGEARGSVVLTAKPVLD (SEQ ID NO: 497) |
| peptide 4 | CVVLTAKPVLDVSPTAPQPEE (SEQ ID NO: 498) |

19.3: Mouse Immunization with Recombinant Aggrecan Protein

Six Balb/c mice were first immunized subcutaneously with 100 micro g of chimeric aggrecan G1-IGD-G2-Fc. Two weeks after the initial immunization, five more weekly doses of the same immunogen were given (50 micro g/dose/mouse). One week after the final immunization, spleen and blood from immunized mice were collected. B cells were pre-incubated with Fc conjugated irrelevant protein to remove Fc binders. Aggrecan-specific B-cells were stained with biotinylated Avi-rabbit aggrecan G1-IGD-G2-3XFLAG and Alexa Fluor 488 labeled rabbit aggrecan IGD-Fc, sorted and plated as described above. After 12-14 days culturing, B-cell culture supernatants were collected for further analysis and cell pellets were cryopreserved.

19.4: B Cells Screening and Antibody Gene Cloning

The binding of antibodies in B cell supernatants to recombinant rabbit aggrecan G1-IGD-G2-FLAG, biotinylated Avi-rabbit aggrecan G1-IGD-G2-3XFLAG, rabbit aggrecan IGD-Fc and native rabbit aggrecan extracted from cartilage were evaluated using ELISA assay. Specific binders were identified and selected for gene cloning.

RNA was extracted from corresponding cell pellets by using ZR-96 Quick-RNA kits (ZYMO RESEARCH). The DNA of their heavy chain and light chain variable regions were amplified by reverse transcription PCR and cloned into expression vectors with heavy chain constant region rbIgG sequence (SEQ ID NO: 518) and expression vector containing the light chain constant region rbIgK sequence (SEQ ID NO: 519) or rbIgK2 (SEQ ID NO: 529) respectively. Recombinant antibodies were expressed transiently in FreeStyle 293F cells according to the manufacturer's instructions (Thermo Fisher) and purified using AssayMAP Bravo platform with protein A cartridge (Agilent). Or conditioned Media expressing recombinant antibodies were applied to purified with protein A (GE Healthcare) affinity chromatography and eluted in PBS, TBS or His buffer (20 mM Histidine, 150 mM NaCl, pH6.0). Size exclusion chromatography was further conducted to remove high molecular weight and/or low molecular weight component. Antibodies derived from rabbit B cells were named GRA0022 to GRA0130, antibodies derived from mouse B cells were named GRA1012 to GRA1025. The constant region of antibodies was changed to human heavy chain constant region SG1 (SEQ ID NO: 520) and to human light chain constant region SK1 (SEQ ID NO: 521) or SK2 (SEQ ID NO: 522), if necessary. The name of antibodies for further characterization was shown in Table 17.

TABLE 17

| Name of antibody | VH Name | VH SEQ ID NO | CH Name | CH SEQ ID NO | VL Name | VL SEQ ID NO | CL Name | CL SEQ ID NO |
|---|---|---|---|---|---|---|---|---|
| GRA0105gg-rbIgG | GRA0105Hg | 516 | rbIgG | 518 | GRA0105Lg | 517 | rbIgK | 519 |
| GRA1013hq-rIgG | GRA1013Hh | 514 | rbIgG | 518 | GRA1013Lq | 515 | rbIgK2 | 529 |
| GRA0124cc-rbIgG | GRA0124Hc | 512 | rbIgG | 518 | GRA0124Lc | 513 | rbIgK | 519 |
| GRA0124cc-SG1 | GRA0124Hc | 512 | SG1 | 520 | GRA0124Lc | 513 | SK2 | 522 |

TABLE 18

Biacore data

| Antigen | Temp (°C.) | ka (M−1s−1) | kd (s−1) | KD (M) |
|---|---|---|---|---|
| GRA0105gg- Human | 37 | 9.110E+4 * | 2.875E−4 * | 3.156E−9 * |
| rbIgG Rabbit | 37 | 5.767E+4 * | 2.546E−4 * | 4.415E−9 * |
| GRA0124cc- Human | 37 | very weak interaction | | |
| rbIgG Rabbit | 37 | 1.197E+4 | 1.391E−2 | 1.162E−6 |
| GRA1013hq- Human | 37 | 2.630E+4 | 4.059E−2 | 1.544E−6 |
| rIgG Rabbit | 37 | 2.118E+4 | 9.732E−3 | 4.594E−7 |

* Fitting was not good due to bi-phasic interaction.

Example 20: Characterization of Anti-Aggrecan Antibody

20.1: Biacore Analysis

The binding affinity of the antibodies at pH 7.4 was determined at 37 degrees C. using Biacore T200 instrument (GE Healthcare). Recombinant Protein A/G (Pierce) was immobilized onto all flow cells of a CM4 sensor chip using amine coupling kit (GE Healthcare). Antibodies and analytes were prepared in buffer (20 mM Sodium Phosphate, 150 mM NaCl, 0.05% Tween 20, 0.005% NaN$_3$, pH 7.4). Each antibody was captured onto the sensor surface by protein A/G. Antibody capture levels were aimed at 200 resonance unit (RU). Each analytes of human G1G2 and Avi RbG1G2 3Flag were injected at 250 nM and 1000 nM, followed by dissociation. Sensor surface was regenerated each cycle with 10 mM Glycine-HCl pH 1.5. As shown in Table 18, binding affinity were determined by processing and fitting the data to 1:1 binding model using Biacore T200 Evaluation software, version 2.0 (GE Healthcare).

Figure 36:
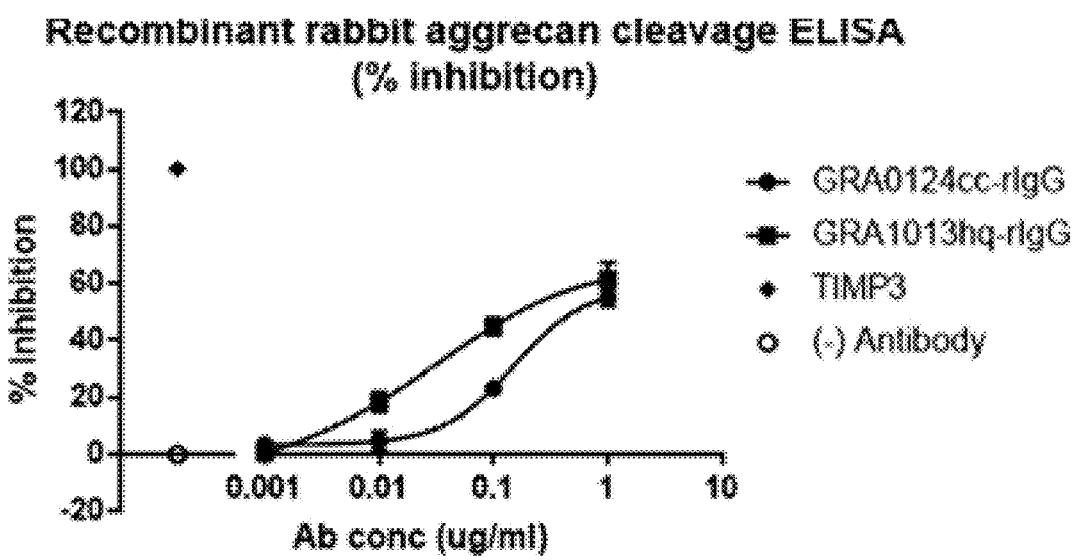
FIG. 36 is a diagram showing results of evaluating the percentage inhibition of rabbit recombinant aggrecan cleavage with GRA0124cc-rbIgG and GRA1013hq-rIgG antibodies, after ADAMTS5 treatment.

20.2: The Inhibitory Activity Against ADAMTS5 Mediated Rabbit Aggrecan Cleavage The inhibitory activity of GRA0124cc-rbIgG and GRA1013hq-rIgG against ADAMTS5 mediated rabbit aggrecan cleavage was evaluated by ELISA. 5 microgram/mL of anti-FLAG M2 antibody (Sigma, F1804) was prepared in phosphate buffered saline (PBS) and immobilized in a 384-well Nunc Maxisorp plate (NUNC, 464718). The plate was left overnight in 4 degrees C. The 384-well coated plate was washed with PBS-Tween20, 100 micro L per well for 4 times using a platewasher. Plate was blotted dry at the final wash before adding blocking buffer (Tris-buffered saline with Tween 20, 0.5% bovine serum albumin and Block Ace) and incubated at 37 degrees C. for 1 hour. Plate was washed and blotted dry as mentioned earlier and recombinant rabbit aggrecan Avi RbG1G2 3Flag was added to wells at a final concentration of 0.05 microgram/mL. The plate was incubated at room temperature for 1 hour before it was washed and blotted dry. Serial diluted antibodies or TIMP3 were prepared and added to respective wells. The plate was incubated at 37 degrees C. for 1.5 hour. ADAMTS5 (R&D systems, 2198-AD) was added to the wells, with a final concentration of 0.625 microgram/mL. The plate was then incubated at 37 degrees C. for 2 hours before it was washed and blotted dry again. Streptavidin-HRP (Pierce, 21130) was then added at 0.1 micrograms/mL and incubated for 1 hour at room temperature. The plate was washed, blotted dry and ABTS substrate (KPL, 50-66-06) was added for color development for 30 minutes. Optical density was measured with multiskan plate reader (Thermo-Scientific) at 405 nm. As rabbit aggrecan Avi RbG1G2 3Flag has biotin at the N-terminus, high OD was detected with uncleaved aggrecan. As shown in FIG. 36, GRA0124cc-rbIgG and GRA1013hq-rIgG antibodies inhibited ADAMTS5 mediated rabbit aggrecan cleavage.

Figure 37:
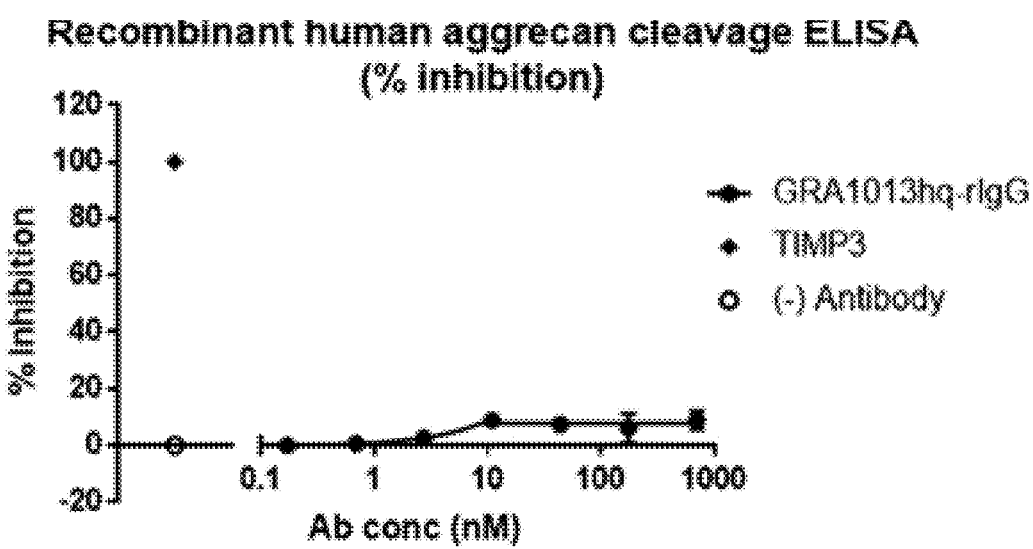
FIG. 37 is a diagram showing results of evaluating the percentage inhibition of human recombinant aggrecan cleavage with GRA1013hq-rIgG antibody, after ADAMTS5 treatment.

20.3: The Inhibitory Activity Against ADAMTS5 Mediated Human Aggrecan Cleavage The inhibitory activity of GRA1013hq-rIgG against ADAMTS5 mediated human aggrecan cleavage was evaluated by ELISA. 5 microgram/mL of GRA0105gg-rbIgG antibody was prepared in PBS and immobilized in a 384-well Nunc Maxisorp plate. The plate was left overnight in 4 degrees C. The 384-well coated plate was washed with PBS-Tween20, 100 micro L per well for 4 times using a platewasher. Plate was blotted dry at the final wash before adding blocking buffer and incubated at 37 degrees C. for 1 hour. Plate was washed and blotted dry and recombinant human Aggrecan G1G2-Flag was added to wells at a final concentration of 1 microgram/mL. The plate was incubated at room temperature for 1 hour before it was washed and blotted dry. Serial diluted antibodies or TIMP3 were prepared and added to respective wells. The plate was incubated at room temperature for 1.5 hours. ADAMTS5 was then added to the wells, with a final concentration of 0.03 microgram/mL. The plate was then incubated at 37 degrees C. for 2 hours before it was washed and blotted dry again. Anti-ARGS aggrecan neo-epitope antibody (R&D systems, MAB64891) was then added at 10 micrograms/mL to wells and incubated for 1 hour at room temperature to detect cleaved aggrecan. The plate was washed, blotted dry and 0.4 microgram/mL rabbit anti-mouse IgG HRP secondary antibody (Thermo, 61-6520) was added to the wells. The plate was incubated at room temperature for 1 hour. A final wash was performed and ABTS substrate was added for color development for 30 minutes. Optical density was measured with multiskan plate reader at 405 nm. As shown in FIG. 37, GRA1013hq-rIgG inhibited ADAMTS5 mediated human aggrecan cleavage.

Example 21 Antibody Engineering of Anti-Aggrecan Antibody

To increase the binding affinity of GRA0124cc, more than 1,000 variants were generated and evaluation of binding affinity at 25 degrees C. and/or 37 degrees C. was carried out using Biacore T200 or 4000 instrument (GE Healthcare). After several round of screening of antibodies to assess the binding ability against human and rabbit aggrecan, GRA0124ccAE02 consisting of GRA0124Hc0626 and GRA0124Lc0544 as variable region of heavy and light chains, respectively, was selected. GRA0124ccAE02 was connected with human constant region, modified human constant region, rabbit constant region, or modified rabbit constant region for further characterization. IC17dK antibody was generated as a negative control. A list of antibodies generated are shown in Table 19.

TABLE 19

| Name of antibody | VH Name | VH SEQ ID NO | CH Name | CH SEQ ID NO | VL Name | VL SEQ ID NO | CL Name | CL SEQ ID NO |
| --- | --- | --- | --- | --- | --- | --- | --- | --- |
| GRA0124ccAE02-rbIgG | GRA0124Hc0626 | 510 | rbIgG | 518 | GRA0124Lc0544 | 511 | rbIgK | 519 |
| GRA0124ccAE02-rIgG008 | GRA0124Hc0626 | 510 | rbIgG008 | 523 | GRA0124Lc0544 | 511 | rbIgK | 519 |
| GRA0124ccAE02-rIgG012 | GRA0124Hc0626 | 510 | rbIgG012 | 524 | GRA0124Lc0544 | 511 | rbIgK | 519 |
| GRA0124ccAE02-SG1 | GRA0124Hc0626 | 510 | SG1 | 520 | GRA0124Lc0544 | 511 | SK2 | 522 |
| IC17dK-SG1 | IC17HdK | 527 | SG1 | 520 | IC17L | 528 | SK1 | 521 |
| IC17dK-rIgG008 | IC17HdK | 527 | rbIgG008 | 523 | IC17L | 528 | rbIgK1 | 525 |

Example 22 Characterization of Engineered Antibody 22.1: Biacore Analysis

The binding affinity of GRA0124ccAE02-rIgG was assessed in Biacore as shown in Example 20. The result is shown in Table 20.

TABLE 20

| | Biacore data | | | | |
|---|---|---|---|---|---|
| | Antigen | Temp (° C.) | ka (M − 1s − 1) | kd (s − 1) | KD (M) |
| GRA0124cc AE02-rIgG | Human | 37 | 1.950E+4 | 1.077E−2 | 5.526E−7 |
| | Rabbit | 37 | 2.039E+4 | 3.332E−4 | 1.635E−8 |

22.2: The Inhibitory Activity Against ADAMTS5 Mediated Rabbit Aggrecan Cleavage

Figure 38:
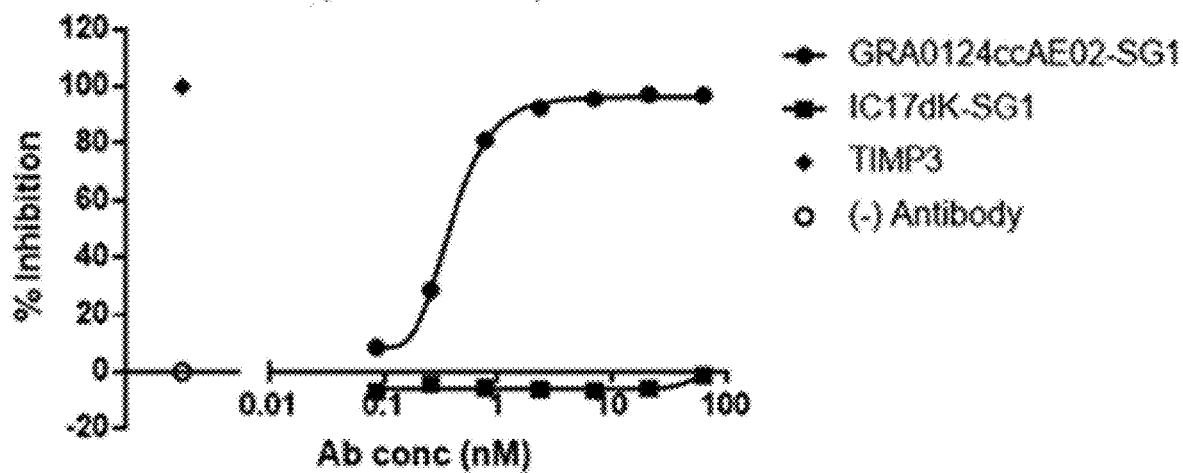
FIG. 38 is a diagram showing results of evaluating the percentage inhibition of rabbit recombinant aggrecan cleavage with GRA0124ccAE02-SG1 antibody, after ADAMTS5 treatment.

The inhibitory activity of GRA124ccAE02-SG1 antibody against ADAMTS5 mediated rabbit aggrecan cleavage was evaluated by ELISA, with IC17dK-SG1 as the isotype control. 5 microgram/mL of GRA0105gg-rbIgG antibody was prepared in PBS and immobilized in a 384-well Nunc Maxisorp plate. The plate was left overnight in 4 degrees C. The 384-well coated plate was washed with PBS-Tween20, 100 micro L per well for 4 times using a platewasher. Plate was blotted dry at the final wash before adding blocking and incubated at 37 degrees C. for 1 hour. Plate was washed and blotted dry and recombinant rabbit aggrecan Avi RbG1G2 3Flag was added to wells at a final concentration of 0.1 microgram/mL. The plate was incubated at 37 degrees C. for 1 hour before it was washed and blotted dry. Serial diluted antibodies or TIMP3 were prepared and added to respective wells. The plate was incubated at 37 degrees C. for 1.5 hours. ADAMTS5 was added to the wells, with a final concentration of 0.15 microgram/mL. The plate was then incubated at 37 degrees C. for 2 hours before it was washed and blotted dry again. HRP labelled Anti-ARGS aggrecan neo-epitope antibody was then added at 10 micrograms/mL and incubated for 1 hour at room temperature to detect cleaved aggrecan. The plate was washed, blotted dry and ABTS substrate was added for color development for 30 minutes. Optical density was measured with Multiskan™ plate reader at 405 nm. As shown in FIG. 38, GRA124ccAE02-SG1 inhibited ADAMTS5 mediated rabbit aggrecan cleavage.

22.3: The Inhibitory Activity Against ADAMTS5 Mediated Human Aggrecan Cleavage

Figure 39:
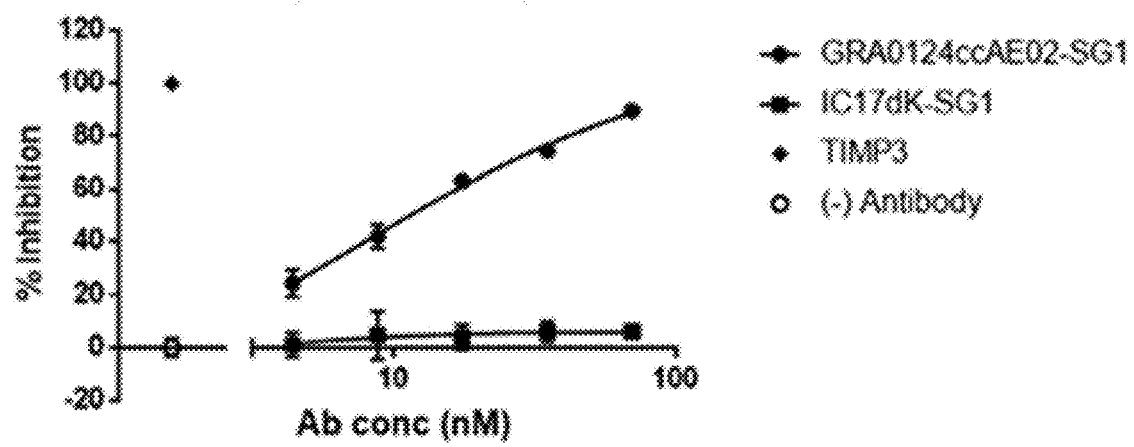
FIG. 39 is a diagram showing results of evaluating the percentage inhibition of human recombinant aggrecan cleavage with GRA0124ccAE02-SG1 antibody, after ADAMTS5 treatment.

The inhibitory activity of GRA124ccAE02-SG1 against ADAMTS5 mediated human aggrecan cleavage was evaluated by ELISA in the same way as in Example 20.3. As shown in FIG. 39, GRA0124ccAE02-SG1 inhibited ADAMTS5 mediated human aggrecan cleavage.

Example 23 Preparation of Fab, F(Ab')2 and VHH Molecules 23.1: GRA0124ccAE02-rIgG008-Fab Cleavage and Purification Purified recombinant GRA0124ccAE02-rIgG008 was cleaved with Endoproteinase LysC enzyme (New England Biolabs, Cat. P8109S) in 10 mM Tris pH 8 buffer for 16 hours at 25 degrees C. After the cleavage, reaction mixture was subjected to Protein A affinity chromatography and flow though having GRA0124ccAE02-rIgG008-Fab was collected and concentrated. Concentrated GRA0124ccAE02-rIgG008-Fab fragment was further refined by size exclusion chromatography using pre-equilibrated Superdex 200 column. Factions containing GRA0124ccAE02-rIgG008-Fab were concentrated and stored in −80 degrees C.

23.2: GRA0124ccAE02-rIgG008-F(Ab')₂ Cleavage and Purification

Purified recombinant GRA0124ccAE02-rIgG008 was cleaved with FabRICATOR LE enzyme (A0-FR8-050) in 50 mM sodium phosphate, 150 mM NaCl pH 6.6 buffer for 2 hours at 37 degrees C. After the cleavage, reaction mixture was subjected to Protein A affinity chromatography and flow though having GRA0124ccAE02-rIgG008-F(ab')₂ was collected and concentrated. Concentrated GRA0124ccAE02-rIgG008-F(ab')₂ fragment was further refined by size exclusion chromatography using pre-equilibrated Superdex 200 column. Factions containing GRA0124ccAE02-rIgG008-F(ab')₂ were concentrated and stored in −80 degrees C.

23.3: GRA0124ccAE02-Fab, IC17dk-Fab Cleavage and Purification

Purified recombinant GRA0124ccAE02-SG1, IC17dk-SG1 were cleaved with Endoproteinase LysC enzyme (New England Biolabs, Cat. P8109S) in 10 mM Tris pH 8 buffer for 30 min at 35 degrees C. After the cleavage, reaction mixture was subjected to Protein A affinity chromatography and flow though having Fab fragment was collected and concentrated. Concentrated GRA0124ccAE02-Fab and IC17dk-Fab were further refined by size exclusion chromatography using pre-equilibrated Superdex 200 column. Factions containing GRA0124ccAE02-Fab and IC17dk-Fab were concentrated and stored in −80 degrees C.

23.4: GRA0124ccAE02-F(Ab')₂ Cleavage and Purification

Purified recombinant GRA0124ccAE02-SG1 was cleaved with FabRICATOR LE enzyme (A0-FR8-050) in 50 mM sodium phosphate, 150 mM NaCl pH 6.6 buffer for 30 min at 37 degrees C. After the cleavage, reaction mixture was subjected to Protein A affinity chromatography and flow though having GRA0124ccAE02-F(ab')₂ was collected and concentrated. Concentrated GRA0124ccAE02-F(ab')₂ was further refined by size exclusion chromatography using pre-equilibrated Superdex 200 column. Factions containing GRA0124ccAE02-F(ab')₂ were concentrated and stored in −80 degrees C.

23.5: PDL1104D2 Purification

Recombinant PDL1104D2 (SEQ ID NO: 526) was expressed transiently in FreeStyle 293F cells according to the manufacturer's instructions (Thermo Fisher) and purified with protein A (GE Healthcare) affinity chromatography and eluted in PBS, TBS or His buffer (20 mM Histidine, 150 mM NaCl, pH6.0). Size exclusion chromatography was further conducted to remove high molecular weight and/or low molecular weight component.

Example 24: In vitro evaluation of cartilage penetration

Figure 40A:
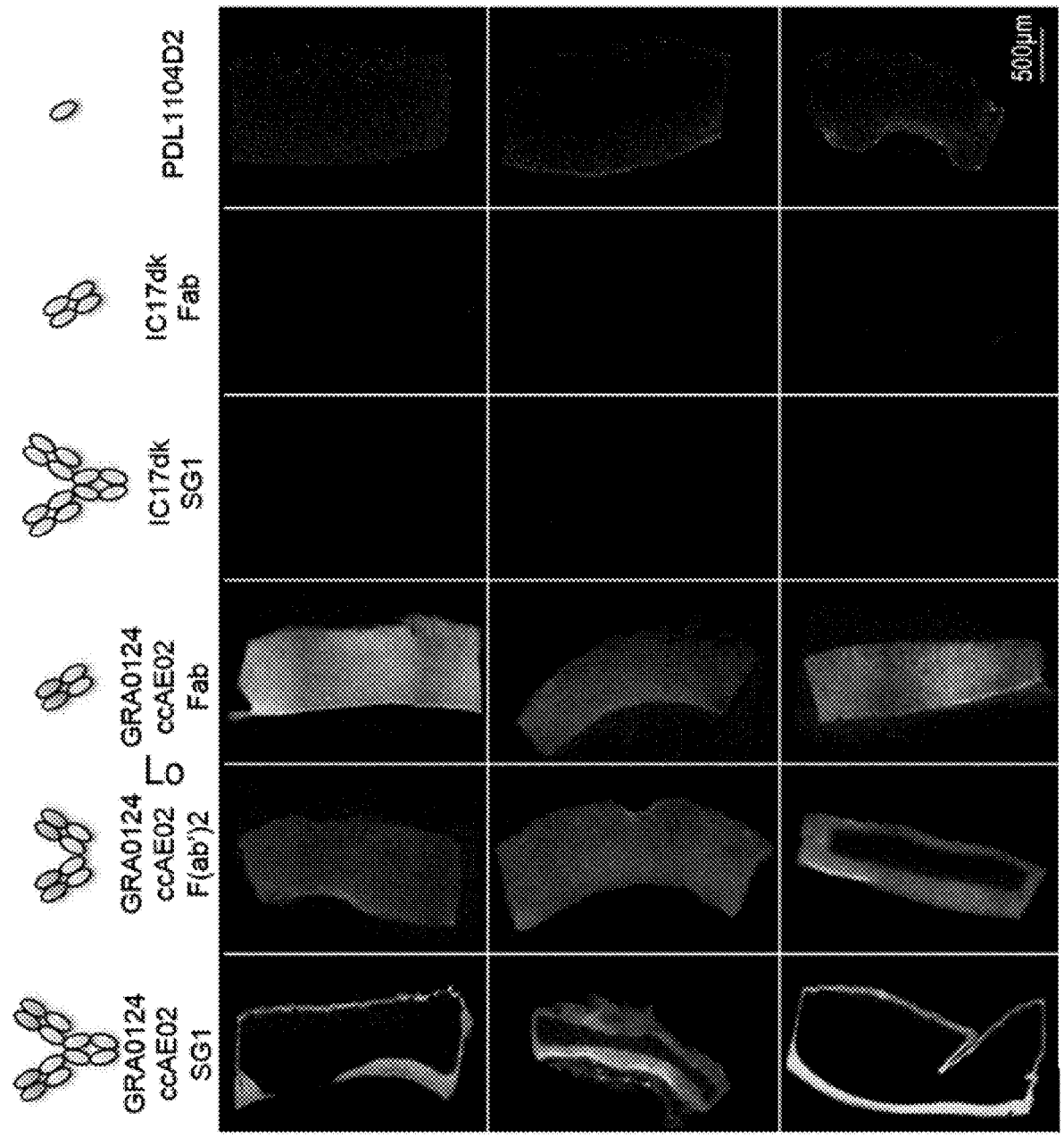
FIG. 40A shows the results of the penetration of fluorescent-labelled antibodies into rabbit cartilage in 24 hours with low intensity laser.
Figure 40B:
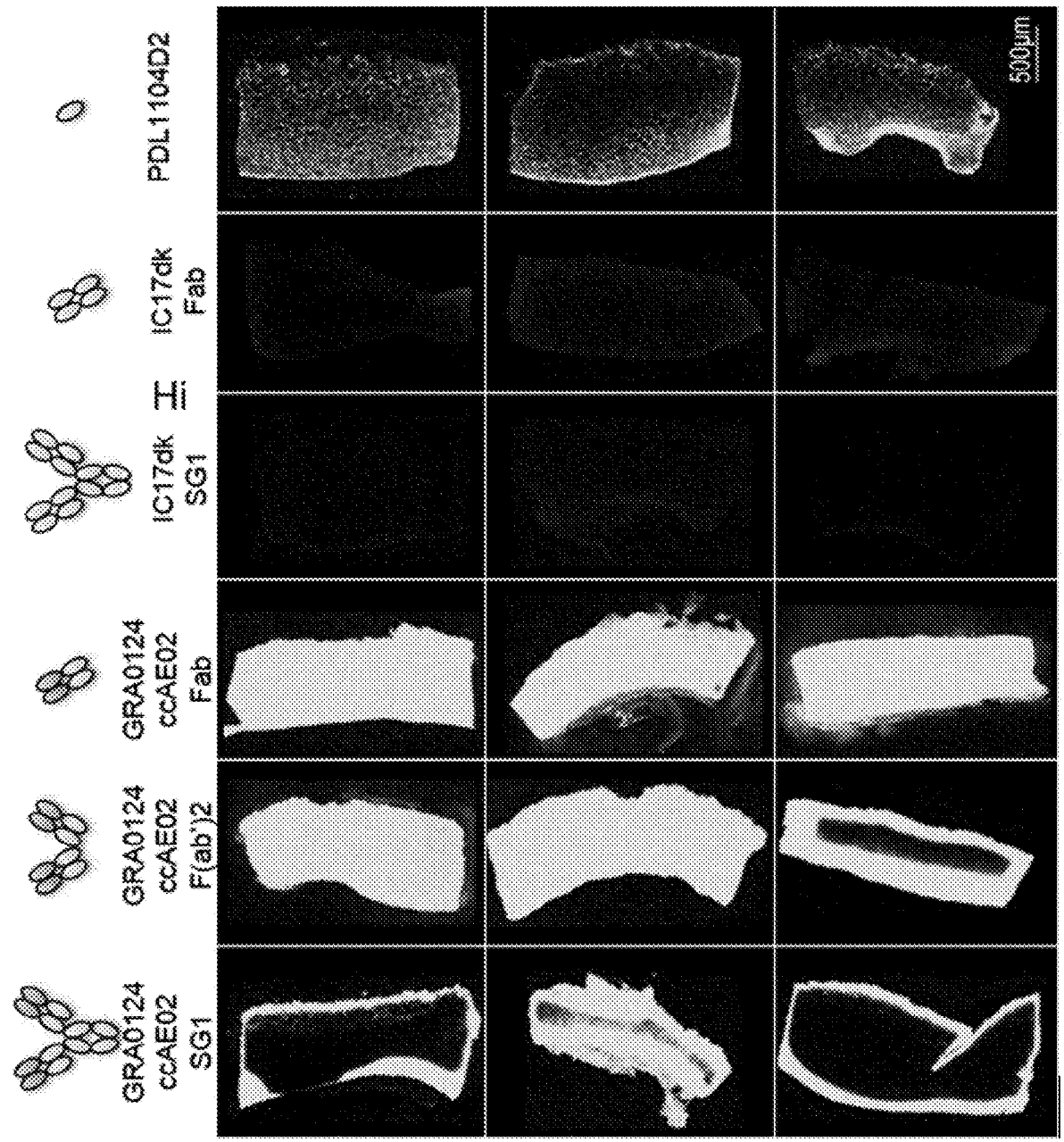
FIG. 40B shows the results of the penetration of fluorescent-labelled antibodies into rabbit cartilage in 24 hours with high intensity laser.

Cartilage penetration of antibodies were studied in rabbit cartilage ex vivo. 2 millimeter cartilage disks punched from rabbit femoral condyle were used in this study. AF488 (Life Technologies, A20181) labelled antibodies were diluted in Dulbecco's Modified Eagle Medium (DMEM) supplemented with 10% fetal bovine serum and 1% Penicillin-Streptomycin before adding to individual cartilage at final concentration of 7 micromolar. Antibodies treated rabbit cartilages were incubated at 37 degrees C. for 24 hours, after that, washed twice with PBS. Cartilages were embedded individually into cryo-blocks and sections were mounted on glass slides and counter stained with DAPI. Slides were imaged in X-Y plane using a confocal microscope (Nikon A1+) at 10× magnification. AF488 dye was excited using 488 nm laser and DAPI was excited with 405 nm laser. Laser power and photomultiplier tube (PMT) settings were kept constant between samples, except that when taking higher intensity images, laser power was adjusted slightly. As shown in FIG. 40A and FIG. 40B, smaller sized antibodies were able to penetrate more compared to conventional antibodies.

Example 25 In Vivo Evaluation of Cartilage Penetration and Retention 25.1 Evaluation for Elimination of an Antibody from Synovial Fluid in Rabbit Joint Pharmacokinetics of anti-aggrecan antibodies and a negative control antibody in synovial fluid, cartilage and plasma were evaluated using white rabbits (Kbl:JW, male, 15 weeks) to determine elimination from synovial fluid and transferability and retention in cartilage.

Anti-aggrecan antibodies (GRA0124ccAE02-rIgG008-Fab, GRA0124ccAE02-rIgG012-F(ab')$_2$ and GRA0124ccAE02-rIgG008) and a negative control antibody (IC17dK-rIgG008) were administered via intra-articular injection to each rabbit at a dose of 8 nmol/joint. Synovial fluid was collected from 5 minutes to 48 hours after intra-articular injection. To collect synovial fluid from the joint, 200 micro L of phosphate buffered saline containing 10 mg/mL of TRITC-Dextran (Sigma Aldrich) were injected into rabbit joint and the leg was bend before obtaining the diluted synovial fluid from the joint. Dilution ratio was calculated by the fluorescence intensity of TRITC-Dextran, which was used to calculate the concentrations of antibodies. Concentrations of antibodies in synovial fluid were measured by electro chemiluminescence immunoassay (ECLIA) with recombinant aggrecan coated plate and a SULFO tag-labeled anti-rabbit polyclonal antibody (MSD) as a detection antibody.

Figure 41:
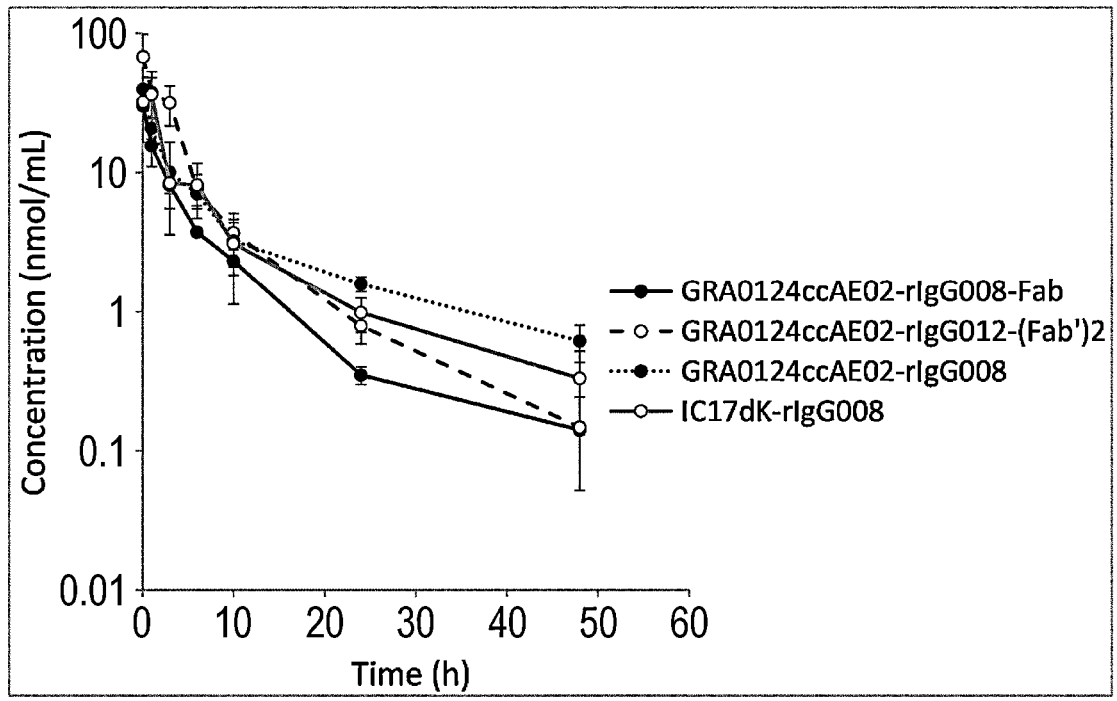
FIG. 41 shows concentration-time profiles of GRA0124ccAE02-rIgG008-Fab, GRA0124ccAE02- rIgG012-F(ab')2, GRA0124ccAE02-rIgG008 and IC17dK-rIgG008 in rabbit synovial fluid after intraarticular administration.

The obtained results are shown in FIG. 41. All antibodies showed concentrations ranging from 30 to 70 nmol/mL at 5 minutes after dosing. At 48 hours after dosing, concentrations of all antibodies were below 1 nmol/mL and showed similar concentration-time profiles. As shown in Table 21, half-life was 17.3 hours in GRA0124ccAE02-rIgG008-Fab, 9.69 hours in GRA0124ccAE02-rIgG012-F(ab')$_2$, 16.8 hours in GRA0124ccAE02-rIgG008 and 14.4 hours in IC17dK-rIgG008 respectively. Total clearance was 0.0814 mL/h in GRA0124ccAE02-rIgG008-Fab, 0.0346 mL/h in GRA0124ccAE02-rIgG012-F(ab')$_2$, 0.0453 mL/h in GRA0124ccAE02-rIgG008 and 0.0484 mL/h in IC17dK-rIgG008 respectively. No significant difference in half-life and total clearance was found among antibodies.

TABLE 21

| Antibody | T1/2 (h) | Clearance (mL/h) |
|---|---|---|
| GRA0124ccAE02-rIgG008-Fab | 17.3 | 0.0814 |
| GRA0124ccAE02-rIgG012-(Fab')2 | 9.69 | 0.0346 |
| GRA0124ccAE02-rIgG008 | 16.8 | 0.0453 |
| IC17dK-rIgG008 | 14.4 | 0.0484 |

Table 21 shows half-life (T1/2) and total clearance of GRA0124ccAE02-rIgG008-Fab, GRA0124ccAE02-rIgG012-F(ab')$_2$, GRA0124ccAE02-rIgG008 and IC17dK-rIgG008 in rabbit synovial fluid after intra-articular administration.

25.2 Evaluation for Penetration and Retention in Rabbit Articular Cartilage

Pharmacokinetic profiles in cartilage was evaluated to determine the penetration and retention of an antibody. Cartilage was scraped from femoral condyle and tibial plateau which were collected from antibody administered rabbits described in Example 25.1. 20 mg of the cartilage pieces were then dissolved in 0.3 M acetic acid buffer (Wako) and homogenized with a homogenizer (Yasui Kikai). After centrifugation of homogenate, the supernatant was diluted by 1 M Tris-HCl (Dojindo) and PBS-T (Sigma Aldrich). Concentrations of antibodies in cartilage were determined by measuring diluted homogenate by ECLIA using similar quantification assay described in Example 25.1.

The results are shown in FIG. 42. At 5 minutes after dosing, the concentration of GRA0124ccAE02-rIgG008-Fab was the highest, followed by GRA0124ccAE02-rIgG012-F(ab')$_2$, GRA0124ccAE02-rIgG008, and IC17dK-rIgG008 which was the lowest. As shown in Table 22, area under the curve (AUC) until 48 hours was 192 nmol*h/mL in GRA0124ccAE02-rIgG008-Fab, 51.7 nmol*h/mL in GRA0124ccAE02-rIgG012-F(ab')$_2$, 7.63 nmol*h/mL in GRA0124ccAE02-rIgG008, and 0.334 nmol*h/mL in IC17dK-rIgG008. GRA0124ccAE02-rIgG008-Fab showed the highest exposure, and GRA0124ccAE02-rIgG012-F(ab')$_2$ and GRA0124ccAE02-rIgG008 showed higher exposure than IC17dK-rIgG008.

Half-life was 22.0 hours in IC17dK-rIgG008, which was the shortest among antibodies. GRA0124ccAE02-rIgG008 and GRA0124ccAE02-rIgG012-F(ab')$_2$ showed 40.5 hours and 68.2 hours respectively, which were longer than a negative control antibody. No reduction of GRA0124ccAE02-rIgG008-Fab was found in this study period, which suggests that GRA0124ccAE02-rIgG008-Fab has slower elimination than IC17dK-rIgG008, GRA0124ccAE02-rIgG008 and GRA0124ccAE02-rIgG012-F(ab')$_2$.

FIG. 43 shows the ratio of concentration in cartilage compared to synovial fluid (cartilage/SF ratio). Although cartilage/SF ratio of IC17dK-rIgG008 was 0.0069 at 48 hours, that of GRA0124ccAE02-rIgG008 was 0.18. The ratio of GRA0124ccAE02-rIgG012-F(ab')$_2$ and GRA0124ccAE02-rIgG008-Fab increased to 5.6 and 31 respectively.

The above results suggested that molecules which bind to aggrecan and have smaller sizes show superiority in penetration to cartilage and retention in cartilage.

Table 22 shows area under the curve (AUC) and half-life of GRA0124ccAE02-rIgG008-Fab, GRA0124ccAE02-rIgG012-F(ab')$_2$, GRA0124ccAE02-rIgG008, and IC17dK-rIgG008 in rabbit articular cartilage after intra-articular administration. Half-life could not be determined accurately for GRA0124ccAE02-rIgG008-Fab because reduction of concentrations was not observed in the terminal phase.

TABLE 22

| Antibody | AUC (nmol * h/mL) | T1/2 (h) |
|---|---|---|
| GRA0124ccAE02-rIgG008-Fab | 192 | NA |
| GRA0124ccAE02-rIgG012-(Fab')2 | 51.7 | 68.2 |
| GRA0124ccAE02-rIgG008 | 7.63 | 40.5 |
| IC17dK-rIgG008 | 0.334 | 22.0 |

25.3 Evaluation of Systemic Exposure after Intra-Articular Administration

Systemic exposure after intra articular administration was evaluated by measuring concentrations of antibodies in plasma after dosing. Blood was collected from antibody administered rabbits described in Example 25.1, and plasma was obtained by centrifugation. Concentrations of antibodies in plasma were measured by ECLIA using similar quantification assay described in Example 25.1.

The results are shown in FIG. 44. Concentrations of GRA0124ccAE02-rIgG008-Fab, GRA0124ccAE02-rIgG012-F(ab')$_2$, and GRA0124ccAE02-rIgG008 were lower than IC17dK-rIgG008 in all time points. AUC was 0.0118 nmol*h/mL in GRA0124ccAE02-rIgG008-Fab, 0.0304 nmol*h/mL in GRA0124ccAE02-rIgG012-F(ab')$_2$, and 0.0709 nmol*h/mL in GRA0124ccAE02-rIgG008 respectively, while 0.889 nmol*h/mL in IC17dK-rIgG008. This suggests that anti-aggrecan antibodies with smaller molecular weight have lower systemic exposure than a negative control antibody.

Table 23 shows area under the curve (AUC) and half-life of GRA0124ccAE02-rIgG008-Fab, GRA0124ccAE02-rIgG012-F(ab')$_2$, GRA0124ccAE02-rIgG008, and IC17dK-rIgG008 in rabbit plasma after intra-articular administration.

TABLE 23

| Antibody | AUC (nmol * h/mL) |
| --- | --- |
| GRA0124ccAE02-rIgG008-Fab | 0.0118 |
| GRA0124ccAE02-rIgG012-(Fab')2 | 0.0304 |
| GRA0124ccAE02-rIgG008 | 0.0709 |
| IC17dK-rIgG008 | 0.889 |

Example 26: Protease-Activated Polypeptide Comprising Single-Domain Antibody Binding to Human Recombinant Aggrecan 26-1 Introduction of Protease Cleavage Sequence to Polypeptide with Incorporated VHH Binding to Human Recombinant Aggrecan and Preparation of IgG Antibody-Like Molecule Against Aggrecan To construct protease-activated IgG antibody-like molecules, a protease cleavage sequence (SEQ ID NO: 494) was inserted near the boundary between the anti-human aggrecan VHH (hA2R3p.038 (SEQ ID NO: 501) and heavy chain constant region (CH1 region).

Expression vectors encoding hA2R3p.038-G1mISHI01 (SEQ ID NO: 492) and VK1.39-k0MT (SEQ ID NO: 3) were prepared by a method known to those skilled in the art. To enhance the VHH and VL association, the mutation discrived in Example 4 were introduced into hA2R3p.038-G1mISHI01 to generate hA2R3p.038v1-G1mISHI01(SEQ ID NO: 493). Protease-activated IgG antibody-like molecules shown in Table 24 below were expressed by transient expression using Expi 293 cells (Invitrogen Corp.) by a method known to those skilled in the art, and purified by a method known to those skilled in the art using protein A.

TABLE 24

| Protease-activated IgG antibody-like molecule | | |
| --- | --- | --- |
| Molecular name | Heavy chain SEQ ID NO: | Light chain SEQ ID NO: |
| hA2R3p.038-G1mISHI01/VK1.39-k0MT | 492 | 3 |
| hA2R3p.038v1-G1mISHI01/VK1.39-k0MT | 493 | 3 |

26-2 Activation of Polypeptide Harboring Protease Cleavage Sequence by Protease Cleavage Whether hA2R3p.038-G1mISHI01/VK1.39-k0MT and hA2R3p.038v1-G1mISHI01/VK1.39-k0MT would release VHH having binding activity against human recombinant aggrecan by protease cleavage was evaluated.

Recombinant Human Matriptase/ST14 Catalytic Domain (R&D Systems, Inc., 3946-SE-010) was used as the protease. 12.5 nM protease and 100 micro g/mL of each IgG antibody-like molecule were reacted in PBS under a condition of 37 degrees C. for 15 hours. Then, cleavage by the protease was evaluated by reducing SDS-PAGE. The results are shown in FIG. 45. As a result, the protease cleavage of the protease cleavage sequence near the boundary between the VHH and the heavy chain constant region was confirmed in hA2R3p.038-G1mISHI01/VK1.39-k0MT and hA2R3p.038v1-G1mISHI01/VK1.39-k0MT.

Next, the human aggrecan binding evaluation of VHH released by protease treatment was conducted using Octet RED (Pall ForteBio Corp.). Specifically, the biotin-labeled Human aggrecan G1-IGD-G2 domain with Flag-tag prepared in Example 17 was bound to a streptavidin sensor (Pall ForteBio Corp., 18-5021), and then each protease treated IgG antibody-like molecule or protease untreated IgG antibody-like molecule was allowed to act thereon, followed by binding evaluation at 27 degrees C. Sensorgrams showing continuous responses measured using Octet RED are shown in FIG. 46. As a result, hA2R3p.038-G1mISHI01/VK1.39-k0MT bound to antigen even when it was not treated with protease, and after treatment of protease, the binding response was lower than protease untreated condition. On the other hand protease treated hA2R3p.038v1-G1mISHI01/VK1.39-k0MT bound to biotinylated human aggrecan more than protease untreated hA2R3p.038v1-G1mISHI01/VK1.39-k0MT. These results demonstrated that the VHH hA2R3p.038, which did not lose its human aggrecan binding activity by associating with VL can form a stable variable region with VL and can lose its aggrecan binding activity, by converting amino acids present at the interface site between the VHH and the VL to 37V, 45L, and 47W (Kabat numbering) and thereby altering the hA2R3p.038 to hA2R3p.038v1. From these results, it was concluded that the molecule conforming to the concept described in Example 2 can also be prepared by a method of combining a light chain with VHH containing a substituted amino acid involved in association with the light chain, in addition to the method of combining a light chain with VHH obtained from alpaca immunization. Furthermore it was concluded that the molecule conforming to the concept described in Example 2 was actually able to be prepared also in the case of aggrecan binding molecule.

26-3 Concept of Protease-Activated Polypeptide Comprising Single-Domain Antibody Having Cartilage Retention and Cartilage Penetration Currently many companies tried to develop protein therapeutics for cartilage diseases including osteoarthritis, rheumatoid arthritis, degenerative disk diseases, skeletal dysplasias, osteochondritis dissecans, and cartilage traumatic injury. However considering the unique structure and components of cartilage, the property of drug molecules should be designed in order to deliver sufficient amount of drug molecules into the cartilage tissue and/or chondrocytes. However current protein therapeutics for cartilage may have several following difficulties to be delivered into cartilage (FIG. 47):

1) Since the molecular size affects penetration into cartilage, whole IgG molecules cannot penetrate into cartilage efficiently. It may result in insufficient therapeutic effect of antibody drugs for treating cartilage diseases such as OA.
2) Polypeptide having small molecular weight cannot be retained in plasma for long time, and it may be more frequently adiministrated than antibody drugs in IgG format.
3) Conventional antibody binds to antigen not only cartilage but systemically when the antigen is present besides cartilage. It will cause side effect and/or short half life by binding the antigen.

Considering these points, the desirable therapeutics for cartilage diseases should have following properties:

1) The drug molecule having ability to penetrate into cartilage and be efficiently retained there in order to demonstrate sufficient efficacy.
2) The drug molecule having long half life in plasma but it doesn't bind to target antigen systemically In the Examples shown above, protease-activated polypeptide comprising single domain antibody was confirmed that antigen binding is inhibited by associating VL domain and retrieve antigen binding when the antigen binding molecule is released from IgG-antibody like molecule by protease digestion at disease site when the protease exists. As shown in the Example 25, anti-Aggrecan antibody could be penetrated and retained in cartilage efficiently, especially when the antibody has smaller size such as F(ab')$_2$ and Fab. Furthermore in the Example 24, the single domain antibody showed better penetration into cartilage in vitro.

From these data, protease-activated polypeptide comprising single domain antibody in this invention will be suitable molecule for treating cartilage disorder as shown in the FIG. 48.

1) The protease-activated polypeptide comprising single domain antibody is expected to have a long half life due to FcRn binding, which is a recycling receptor for IgG, and minimize systemic antigen binding.
2) After protease digestion at the disease site, the antigen binding domain, which has small molecular weight, is released from IgG-antibody like molecule and can penetrate into cartilage, bind to antigen and be retained in cartilage efficiently.
3) Once the single domain antibody is released into circulation, the antigen binding domain will be cleared rapidly from circulation and it works specifically within the local site.

Furthermore, in the case of the antigen binding domain has ECM component binding activity such as aggrecan, the antigen binding domain can be retained into cartilage. Considering penetration and retention of multiple antigen binding domains including targeting domain which binds to molecule present in a cartilage and agonist or antagonist molecule, as depicted in FIG. 49, the released antigen binding domain with agonist or antagonist can penetrate into cartilage efficiently and retain there for a long time.

Example 27: Preparation of Antibodies and Fabs 27-1 Antibodies

Previous Example described antibodies having different epitopes and different affinity. The summary of antibodies for various evaluations is shown in Table 25. The full length antibodies for affinity measurement were prepared by same method in the previous example.

TABLE 25

| | | Antibodies | | | |
|---|---|---|---|---|---|
| Full length antibody name | H chain name | H chain sequence ID | L chain | L chain sequence ID | Fab name in the cartilage penetration/retention assay prepared in 27-2 |
| GRA1013Hhz-SG1/GRA1013Lqz-SK2 | GRA1013Hhz-SG1 | 547 | GRA1013Lqz-SK2 | 555 | GRA1013hzqz-SG1 Fab |
| GRA0105Hg-SG1/GRA0105Lg-SK2 | GRA0105Hg-SG1 | 548 | GRA0105Lg-SK2 | 556 | GRA0105gg-SG1 Fab |
| GRA0124Hc-SG1/GRA0124Lc-SK2 | GRA0124Hc-SG1 | 549 | GRA0124Lc-SK2 | 557 | GRA0124cc-SG1 Fab |
| GRA0124Hc0626-SG1/GRA0124Lc0544-SK2 | GRA0124Hc0626-SG1 | 550 | GRA0124Lc0544-SK2 | 558 | GRA0124c0626c0544-SG1 Fab |
| GRA0124Hc0626-SG1/GRA0124Lc0694-SK2 | GRA0124Hc0626-SG1 | 550 | GRA0124Lc0694-SK2 | 559 | GRA0124c0626c0694-SG1 Fab |

TABLE 25-continued

| Antibodies | | | | | |
|---|---|---|---|---|---|
| Full length antibody name | H chain name | H chain sequence ID | L chain | L chain sequence ID | Fab name in the cartilage penetration/retention assay prepared in 27-2 |
| GRA0124Hc0626-SG1/GRA0124Lc0951-SK2 | GRA0124Hc0626-SG1 | 550 | GRA0124Lc0951-SK2 | 560 | GRA0124c0626c0951-SG1 Fab |
| GRA0124Hc1075-SG1/GRA0124Lc0952-SK2 | GRA0124Hc1075-SG1 | 551 | GRA0124Lc0952-SK2 | 561 | GRA0124c1075c0952-SG1 Fab |
| IC17HdK-SG1/IC17L-k0 | IC17HdK-SG1 | 552 | IC17L-k0 | 562 | IC17dk-SG1 Fab (Negative control) |
| GRA0124Hc0626-SG1/GRA0124Lc0544-SK2 | GRA0124Hc0626-SG1 | 550 | GRA0124Lc0544-SK2 | 558 | FabGRA0124ccAE02-SG1/SK2 (GRA0124ccAE02-SG1/SK2 Fab) |
| GRA0124Hc0626-SG1/GRA0124Lc0544-SK2 | GRA0124Hc0626-SG1 | 550 | GRA0124Lc0544-SK2 | 558 | FabGRA0124ccAE02-SG1265/SK2 (GRA0124ccAE02-SG1265/SK2 Fab) |
| GRA0124Hc0626-SG1265/GRA0124Lc0544-SK2 | GRA0124Hc0626-SG1265 | 553 | GRA0124Lc0544-SK2 | 558 | FabGRA0124ccAE02-SG1286/SK2 (GRA0124ccAE02-SG1286/SK2 Fab) |
| GRA0124Hc0626-SG1286/GRA0124Lc0544-SK2021 | GRA0124Hc0626-SG1286 | 554 | GRA0124Lc0544-SK2021 | 563 | FabGRA0124ccAE02-SG1/SK2021 (GRA0124ccAE02-SG1/SK2021 Fab) |
| GRA0124Hc0626-SG1/GRA0124Lc0544-SK2021 | GRA0124Hc0626-SG1 | 550 | GRA0124Lc0544-SK2021 | 564 | FabGRA0124ccAE02-SG1265/SK2021 (GRA0124ccAE02-SG1265/SK2021 Fab) |
| GRA0124Hc0626-SG1265/GRA0124Lc0544-SK2025 | GRA0124Hc0626-SG1265 | 553 | GRA0124Lc0544-SK2025 | 565 | FabGRA0124ccAE02-SG1286/SK2025 (GRA0124ccAE02-SG1286/SK2025 Fab) |
| GRA0124Hc0626-SG1286/GRA0124Lc0544-SK2027 | GRA0124Hc0626-SG1286 | 554 | GRA0124Lc0544-SK2027 | 566 | FabGRA0124ccAE02-SG1286/SK2027 (GRA0124ccAE02-SG1286/SK2027 Fab) |

27-2 Antibody Expression and Fab Cleavage and Purification

Recombinant antibodies were expressed transiently using the Expi 293-F cells and Expifectamine 293 (Life technologies), according to the manufacturer's instructions. Conditioned media expressing recombinant antibodies were applied to protein A (GE Healthcare) affinity chromatography and eluted in PBS buffer. Eluates were further subjected to Fab cleavage using immobilized FabaLACTICA enzyme (Genovis AB) according to the manufacturer's instructions. After cleavage, Fc and uncleaved IgG was removed by ProA affinity chromatography. Flow through containing Fab fragment was concentrated and further refined by size exclusion chromatography using pre-equilibrated Superdex 200 column. Factions containing monomer Fab fragment were concentrated and stored in −80 degrees C.

Example 28: Characterization of Anti-Aggrecan Antibody 28-1: Biacore Analysis The binding affinity of the antibodies at pH 7.4 was determined at 37 degrees C. using Biacore T200 instrument (GE Healthcare) according to Example 20. Anti-Human IgG (Fc) antibody was immobilized onto all flow cells of a CM4 sensor chip using Human antibody capture kit (GE Healthcare). Protein A/G was immobilized onto all flow cells of a CM4 or C1 sensor chip using amine coupling kit (GE Healthcare). Antibodies and analytes were prepared in buffer (50 mM Sodium Phosphate, 150 mM NaCl, 0.02% Tween 20, 0.005% NaN3, pH 7.4 or 20 mM Sodium Phosphate, 150 mM NaCl, 0.05% Tween20, 0.005% $NaN_3$, pH 7.4). Each antibody was captured onto the sensor surface by Anti-Human IgG (Fc) antibody or Protein A/G. Antibody capture levels were aimed at 200 resonance unit (RU). Each analytes of Avi RbG1G2 3Flag were injected at from 125 to 1000 nM, followed by dissociation. Sensor surface was regenerated each cycle with 3 M $MgCl_2$ or 10 mM Glycine-HCl, pH 1.5. As shown in Table 26, binding affinity were determined by processing and fitting the data to 1:1 binding model using Biacore T200 Evaluation software, version 2.0 (GE Healthcare).

TABLE 26

Biacore data

| Clone name | Avi RbG1G2 3Flag | | |
|---|---|---|---|
| | ka (1/Ms) | kd (1/s) | KD (M) |
| AG_GRA1013Hhz-SG1/GRA1013Lqz-SK2 | 5.76E+04 | 1.47E−02 | 2.56E−07 |
| AG_GRA0105Hg-SG1/GRA0105Lg-SK2 | 1.39E+05 | 4.55E−04 | 3.28E−09 |
| AG_GRA0124Hc-SG1/GRA0124Lc-SK2 | 9.56E+04 | 1.36E−02 | 1.42E−07 |
| AG_GRA0124Hc0626-SG1/GRA0124Lc0544-SK2 | 5.39E+04 | 8.38E−04 | 1.56E−08 |
| AG_GRA0124Hc0626-SG1/GRA0124Lc0694-SK2 | 2.61E+04 | 2.02E−03 | 7.75E−08 |
| AG_GRA0124Hc0626-SG1/GRA0124Lc0951-SK2 | 7.94E+04 | 3.21E−04 | 4.04E−09 |
| AG_GRA0124Hc1075-SG1/GRA0124Lc0952-SK2 | 7.27E+04 | 2.67E−04 | 3.68E−09 |
| AG_GRA0124Hc0626-SG1/GRA0124Lc0544-SK2 | 8.38E+04 | 3.41E−04 | 4.07E−09 |
| AG_GRA0124Hc0626-SG1265/GRA0124Lc0544-SK2 | 5.27E+04 | 8.37E−04 | 1.59E−08 |
| AG_GRA0124Hc0626-SG1286/GRA0124Lc0544-SK2 | 5.19E+04 | 8.83E−04 | 1.70E−08 |
| AG_GRA0124Hc0626-SG1/GRA0124Lc0544-SK2021 | 5.35E+04 | 7.18E−04 | 1.34E−08 |
| AG_GRA0124Hc0626-SG1265/GRA0124Lc0544-SK2021 | 5.27E+04 | 7.57E−04 | 1.44E−08 |
| AG_GRA0124Hc0626-SG1286/GRA0124Lc0544-SK2025 | 5.19E+04 | 7.86E−04 | 1.52E−08 |
| AG_GRA0124Hc0626-SG1286/GRA0124Lc0544-SK2027 | 5.17E+04 | 7.80E−04 | 1.51E−08 |
| AG_0A2R2#041un-G1T3dCH1dC/- | 2.45E+04 | 1.87E−02 | 7.63E−07 |

28-2: pI Measurement of Fab Domain for Cartilage Penetration/Retention

The pI of antibodies for cartilage penetration/retention assay was measured by Maurice (proteinsimple) according to the manufacturer's instructions. The measured pI was shown in the Table 27.

TABLE 27

| pI of antibodies | |
| --- | --- |
| Clone name | pI |
| FabGRA0124ccAE02-SG1/SK2 | 9.89 |
| FabGRA0124ccAE02-SG1265/SK2 | 9.75 |
| FabGRA0124ccAE02-SG1286/SK2 | 9.41 |
| FabGRA0124ccAE02-SG1/SK2021 | 9.35 |
| FabGRA0124ccAE02-SG1265/SK2021 | 8.82 |
| FabGRA0124ccAE02-SG1286/SK2025 | 8.00 |
| FabGRA0124ccAE02-SG1286/SK2027 | 6.82 |
| GRA1013hzqz-SG1 Fab | 9.45 |
| GRA0105gg-SG1 Fab | 9.30 |
| GRA0124cc-SG1 Fab | 9.79 |
| GRA0124c0626c0544-SG1 Fab | 9.90 |
| GRA0124c0626c0694-SG1 Fab | 9.89 |
| GRA0124c0626c0951-SG1 Fab | 8.46 |
| GRA0124c1075c0952-SG1 Fab | 6.11 |

Example 29: Ex Vivo Evaluation for Retention Using Rabbit Articular Cartilage

To evaluate retention capability of Fabs which bind to aggrecan, remained Fab concentration in cartilage for 6 days after 1 day exposure of 3.5 micro g/mL of Fabs to cartilage was evaluated. 2 millimeter cartilage disks punched from rabbit femoral condyle were used in this study. Initial Fab concentration into cartilage was evaluated immediately after 1 day Fab incubation. To evaluate remained Fab concentration in cartilage, cartilage was washed by cold PBS after 1 day incubation, followed by incubation for 6 days in fresh medium. Three cartilages were used for each experiment. Fab retention capability was evaluated by comparison of the Fab cartilage concentration between initial and remained into cartilage. Harvested cartilage was dissolved in low pH buffer (10 mM citric acid-HCl pH3, 150 mM NaCl and 1% Tween 20) and then homogenized with a Retsch MM400 homogenizer. Fab concentration was quantified by ECLIA with anti-human IgG (Fab specific from Sigma) coated on plate and SULFO tag-labeled anti-human IgG (H+L from Novus) as a detection antibody. The initial Fab concentration and the concentration of 6 days after incubation are shown in FIG. 50. The initial Fab concentration of all tested anti-aggrecan antibodies was similar and higher than negative control, IC17-SG1 Fab whose concentration in cartilage was not detected (lower limit of quantification was 0.63 ng/mL when the cartilage pieces were dissolved by 500 micro L of lysis buffer)

The Fab retention determined by the following formula is shown in the FIG. 51. (Fab retention)=(Fab concentration of 6 days after incubation)/(Initial Fab concentration)

Example 30: Evaluation for Uptake of VHH in Rabbit Explant Culture

Uptake of anti-aggrecan VHHs and negative control VHHs (anti-RSV VHHs) was evaluated using rabbit cartilage explant culture obtained from white rabbits cartilage (Kbl:JW, male, 15 weeks) to reveal VHH penetration into cartilage.

All VHHs, SD_oA2R2 #041un-GSHIS/VLn-CLn(SEQ ID: 543), SD_oA2R2 #041un-GSHISFLAG/VLn-CLn(SEQ ID: 544), SD_RSV191D3-GSHIS/VLn-CLn(SEQ ID: 545) and SD_RSV191D3-HISFLAG/VLn-CLn(SEQ ID: 546) were expressed by Expi293 cell and purified by His tag affinity chromatography and followed by gel filtration chromatography by a method known to those skilled in the art.

Anti-aggrecan VHHs, SD_oA2R2 #041un-GSHIS/VLn-CLn(SEQ ID: 543) and SD_oA2R2 #041un-GSHISFLAG/VLn-CLn(SEQ ID: 544), and negative control VHHs, SD_RSV191D3-GSHIS/VLn-CLn(SEQ ID: 545) and SD_RSV191D3-HISFLAG/VLn-CLn(SEQ ID: 546) were applied to rabbit cartilage explant culture at a concentration of 0.5 and 5 nmol/mL. After 24 hours, medium was removed, and cartilage was washed by phosphate buffered saline, then cartilage was collected. After that the cartilage disc was dissolved by 0.3 M acetic acid buffer (Wako) and homogenized with a homogenizer (Yasui Kikai). After centrifugation of homogenate, the supernatant was diluted by 1 M Tris-HCl (Dojindo) and PBS-T (Sigma Alfrich). Concentrations of VHHs in cartilage disc were measured by the electro chemiluminescence immunoassay (ECLIA) using aggrecan protein or RSV protein for coating and anti-alpaca antibody for detection.

The obtained results are shown in FIG. 52. In all antibodies, uptake into cartilage at the concentration of 5 nmol/mL showed higher uptake amount than that of 0.5 nmol/mL. Regardless of tag modifications, both SD_oA2R2 #041un-GSHIS/VLn-CLn and SD_oA2R2 #041un-GSHIS-FLAG/VLn-CLn showed higher uptake amount in cartilage compared to SD_RSV191D3-GSHIS/VLn-CLn and SD_RSV191D3-HISFLAG/VLn-CLn, respectively. The Fab domain containing variable region of anti-aggrecan antibody (VH: GRA0124Hc0626, VL: GRA0124Lc0544) was higher concentration at the same condition compared with SD_RSV191D3-HISFLAG/VLn-CLn (data not shown).

This phenomenon suggested that once the anti-aggrecan VHH or VHHs containing aggrecan binding VHH is released from whole IgG shown in the FIGS. 48 and 49, the VHH or VHHs will penetrate into cartilage better than non binding control or whole IgG.

As shown in the FIG. 50 and FIG. 51 Fab domain which binds to aggrecan showed efficient cartilage penetration and retention than that of negative control molecule. In addition to this, as also shown in the FIG. 42, Fab domain showed better penetration and retention than whole IgG. In the aspect of penetration and retention, Fab domain or VHH should be considered advantageous for treatment of cartilage diseases. However the Fab domain alone or single domain antibody alone is known to have short half life. To achieve long term duration or half life in vivo with highly efficient cartilage penetration and retention, molecule having anti-Aggrecan antigen binding domain such as Fab or VHH and Fc region or half life extension domain such as albumin binding domain followed by protease digestion site can be constructed. In the case of connection of Fab or single domain antibody with Fc region, the protease digestion sequence (protease cleavable sequence) can be inserted into N terminal of Cys at position 226 (EU numbering) in hinge region to generate "isolated" Fab domain or single domain antibody efficiently. The preferable position(s) for insertion or altenation or mutation will be from position 201 to 228 (EU numbering). The more preferable position(s) for insertion or alternation or mutation will be from position 201 to 226 (EU numbering). As long as generation of Fab domain or single domain antibody which has antigen binding activity is achieved, any position can be selected. When albumin and albumin binding domain is used for half life extention, due to additional molecular weight brought by albumin, the antigen binding domain with albumin binding domain having albumin may result in less penetration into cartilage compared with antigen binding domain alone. When anti-aggrecan antigen binding domain conjugates comprising albumin binding domain with protease cleavable sequence are desinged, the preferable position for protease cleavable sequence will be between the anti-aggrecan binding domain and albumin binding domain.

Reference Example 1 Preparation of Biotinylated Plexin A1

Biotinylated plexin A1 (also referred to as biotin-labeled human plexin A1) was prepared by a method known to those skilled in the art. Specifically, a gene fragment encoding a specific sequence (AviTag sequence; SEQ ID NO: 36) to be biotinylated by biotin ligase and a gene fragment encoding a FLAG tag sequence (SEQ ID NO: 199; DYKDDDDK) were linked via a gene fragment encoding a linker constituted by glycine and serine to downstream of a gene fragment encoding the extracellular region of plexin A1. A gene fragment encoding a protein containing plexin A1 linked to the AviTag sequence and the FLAG tag sequence (SEQ ID NO: 200) was integrated to a vector for expression in animal cells. The constructed plasmid vector was transferred to FreeStyle 293 cells (Invitrogen Corp.) using 293Fectin (Invitrogen Corp.). In this operation, the cells were cotransfected with a gene for EBNA1 (SEQ ID NO: 57) expression and a gene for biotin ligase (BirA; SEQ ID NO: 58) expression, and biotin was further added thereto for the purpose of biotin-labeling plexin A1. The cells transfected according to the procedures mentioned above were cultured at 37 degrees C. under 8% $CO_2$ and caused to secrete the protein of interest (biotinylated plexin A1) into the culture supernatant. This cell culture solution was filtered through a 0.22 micro m bottle-top filter to obtain a culture supernatant.

A column was packed with Anti FLAG M2 agarose (Sigma-Aldrich Co. LLC, #A2220) to prepare a FLAG column. The FLAG column was equilibrated in advance with D-PBS(−). The culture supernatant was applied thereto to bind the biotinylated plexin A1 to the column. Subsequently, the biotinylated plexin A1 was eluted using FLAG peptide dissolved in D-PBS(−). Associates were removed from this eluate by gel filtration chromatography using HiLoad 26/600 Superdex 200 pg, 320 mL (GE Healthcare Japan Corp., 28-9893-36) to obtain purified biotinylated plexin A1.

The embodiments of the invention mentioned above are described in detail with reference to actual examples and illustrated examples with the aim of helping clear understanding. However, the description and illustration in the present specification should not be interpreted as limiting the scope of the present invention. The disclosure of all patent literatures and scientific literatures cited herein is explicitly incorporated herein by reference in its entirety.

INDUSTRIAL APPLICABILITY

The polypeptide of the present invention comprising an antigen binding domain and a carrying moiety having a longer half-life in blood than that of the antigen binding domain and having an inhibiting domain that inhibits the binding activity of the antigen binding domain, and a pharmaceutical composition comprising the polypeptide can transport the antigen binding domain in blood while inhibited the antigen binding activity of the antigen binding domain. Also, use of the polypeptide of the present invention can allow the antigen binding domain to exert its antigen binding activity specifically at a disease site. Furthermore, since the antigen binding domain has a shorter half-life at the time of exerting its antigen binding activity than at the time of transport, the risk of acting systemically is decreased. Thus, the polypeptide and the pharmaceutical composition of the present invention are very useful in the treatment of a disease.

A single-domain antibody whose antigen binding activity is inhibited by associating with particular VL, VH or VHH can be screened for or produced as one example of the antigen binding domain to thereby efficiently produce the polypeptide of the present invention. Furthermore, a necessary antigen binding domain can be efficiently obtained when the polypeptide of the present invention is prepared by use of a library including the single-domain antibody whose antigen binding activity is inhibited by associating with particular VL, VH or VHH, as one example of the antigen binding domain that can be used in the polypeptide of the present invention.

Sequence Listing

---

SEQUENCE LISTING (566 sequences)

SEQ ID NO: 1 - protein, 127 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 2 - protein, 455 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 3 - protein, 214 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 219 aa, Artificial Sequence
  an artificially synthesized sequence
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQRLHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5 - protein, 215 aa, Artificial Sequence
  an artificially synthesized sequence
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 217 aa, Artificial Sequence
  an artificially synthesized sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLNAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7 - protein, 216 aa, Artificial Sequence
  an artificially synthesized sequence
QSVLTQPPSASGTPGQRVTISCSGSSSNIGSNTVNWYQQLPGTAPKLLIYSNNQRPSGVPDRFSGSKSGTSASLAISGLQSEDEADYYCGTWDGGVTGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8 - protein, 217 aa, Artificial Sequence
  an artificially synthesized sequence
QSALTQPASVSGSPGQSITISCTGTSSDVGGYNYVSWYQQHPGKAPKLMIYEVSNRPSGVSNRFSGSKSGNTASLTISGLQAEDEADYYCSSYRSGYTLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9 - protein, 213 aa, Artificial Sequence
  an artificially synthesized sequence
SYVLTQPPSVSVAPGKTARITCGGNNIGSKSVHWYQQKPGQAPVLVIYYDSDRPSGIPERFSGSNSGNTATLTISRVEAGDEADYYCQAWDSSTDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 10 - protein, 107 aa, Homo sapiens [sequence omitted]

SEQ ID NO: 11 - protein, 106 aa, Homo sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 12 - protein, 8 aa, Artificial Sequence
  an artificially synthesized sequence
LSGRSDNH

SEQ ID NO: 13 - protein, 463 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 14 - protein, 473 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASSGGSGLSGRSDNHGSSGGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 15 - protein, 464 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVLSGRSDNHGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 16 - protein, 473 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 17 - protein, 464 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKLSGRSDNHGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 18 - protein, 473 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKSGGSGLSGRSDNHGSSGGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 19 - protein, 121 aa, Artificial Sequence [sequence omitted]

SEQ ID NO: 20 - protein, 121 aa, Artificial Sequence
  an artificially synthesized sequence
EVQLVESGGGLVQPGGSLRLSCAASGSVFKINVMAWVRQAPGKGLEWVAGIISGGSTSYADSVKGRFTISRDNAKNTLYLQMNSLRPEDTAVYYCAFITTESDYDLGRRYWGQGTLVTVSS

SEQ ID NO: 21 - protein, 330 aa, Homo sapiens [sequence omitted]

SEQ ID NO: 22 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 23 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 24 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 25 - protein, 6 aa, Artificial Sequence
  an artificially synthesized sequence
PLGLAG

SEQ ID NO: 26 - protein, 8 aa, Artificial Sequence
  an artificially synthesized sequence
VPLSLTMG

SEQ ID NO: 27 - protein, 5 aa, Artificial Sequence
  an artificially synthesized sequence
GSGGS

SEQ ID NO: 28 - protein, 4 aa, Artificial Sequence
  an artificially synthesized sequence
GGGS

SEQ ID NO: 29 - protein, 4 aa, Artificial Sequence
  an artificially synthesized sequence
GGSG

SEQ ID NO: 30 - protein, 5 aa, Artificial Sequence
  an artificially synthesized sequence
GGSGG

SEQ ID NO: 31 - protein, 5 aa, Artificial Sequence
  an artificially synthesized sequence
GSGSG

SEQ ID NO: 32 - protein, 5 aa, Artificial Sequence
  an artificially synthesized sequence
GSGGG

SEQ ID NO: 33 - protein, 5 aa, Artificial Sequence
  an artificially synthesized sequence
GGGSG

SEQ ID NO: 34 - protein, 5 aa, Artificial Sequence
  an artificially synthesized sequence
GSSSG

SEQ ID NO: 35 - protein, 338 aa, Homo sapiens
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQ

SEQ ID NO: 36 - protein, 15 aa, Artificial Sequence
  an artificially synthesized sequence
GLNDIFEAQKIEWHE

SEQ ID NO: 37 - protein, 358 aa, Artificial Sequence
  an artificially synthesized sequence
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQGGGGSGLNDIFEAQKIEWHE

SEQ ID NO: 38 - protein, 449 aa, Artificial Sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 39 - protein, 449 aa, Artificial Sequence
  an artificially synthesized sequence
EVQLVESGGGLVQPGGSLRLSCAASGSVFKINVMAWVRQAPGKGLEWVAGIISGGSTSYADSVKGRFTISRDNAKNTLYLQMNSLRPEDTAVYYCAFITTESDYDLGRRYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 40 - protein, 457 aa, Artificial Sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASLSGRSDNHTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 41 - protein, 467 aa, Artificial Sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASSGGSGLSGRSDNHGSSGGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 42 - protein, 467 aa, Artificial Sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 43 - protein, 467 aa, Artificial Sequence
  an artificially synthesized sequence
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSASTKSGGSGLSGRSDNHGSSGGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 44 - protein, 18 aa, Artificial Sequence
  an artificially synthesized sequence
SGGSGLSGRSDNHGSSGG

SEQ ID NO: 45 - protein, 9 aa, Artificial Sequence
  an artificially synthesized sequence
LSGRSDNHG

SEQ ID NO: 46 - protein, 4 aa, Artificial Sequence
  an artificially synthesized sequence
GSGG

SEQ ID NO: 47 - protein, 4 aa, Artificial Sequence
  an artificially synthesized sequence
SGGG

SEQ ID NO: 48 - protein, 4 aa, Artificial Sequence
  an artificially synthesized sequence
GSSG

SEQ ID NO: 49 - protein, 5 aa, Artificial Sequence
  an artificially synthesized sequence
GGGGS

SEQ ID NO: 50 - protein, 6 aa, Artificial Sequence
  an artificially synthesized sequence
GGGGGS

SEQ ID NO: 51 - protein, 5 aa, Artificial Sequence
  an artificially synthesized sequence
SGGGG

SEQ ID NO: 52 - protein, 5 aa, Artificial Sequence
  an artificially synthesized sequence
GSSGG

SEQ ID NO: 53 - protein, 5 aa, Artificial Sequence
  an artificially synthesized sequence
SGGSG

SEQ ID NO: 54 - protein, 6 aa, Artificial Sequence
  an artificially synthesized sequence
SGGGGG

SEQ ID NO: 55 - protein, 7 aa, Artificial Sequence
  an artificially synthesized sequence
GGGGGGS

SEQ ID NO: 56 - protein, 7 aa, Artificial Sequence
  an artificially synthesized sequence
SGGGGGG

SEQ ID NO: 57 - protein, 641 aa, Human herpesvirus 4
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 58 - protein, 321 aa, Escherichia coli
MKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 59 - protein, 373 aa, Artificial Sequence
  an artificially synthesized sequence
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGGSGENLYFQGSGGGLNDIFEAQKIEWHE

SEQ ID NO: 60 - protein, 323 aa, Artificial Sequence
  an artificially synthesized sequence
FKIPIEELEDRVFVNCNTSITWVEGTVGTLLSDITRLDLGKRILDPRGIYRCNGTDIYKDKESTVQVHYRMCQSCVELDDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 61 - protein, 123 aa, Vicugna pacos
QVQLVESGGGLVQPGGSLRLSCAASGFTFNHCWMYWVRQAPGKGLEWVSVINTDGGSAYYADSVKGRFTISRDNAKNTLYLQMNSLKSEDTAVYYCARDWAPLVDYYYGMDYWGKGTLVTVSG

SEQ ID NO: 62 - protein, 121 aa, Vicugna pacos
QVQLVESGGGLVQPGGSLRLSCAASGFPFDNYVMSWVRQAPGKGLEWISAISWNGGSTYYAESMKGRFTISRDNAKSTLYLQMNSLKSEDTAVYYCAKEPRVYYSGSPDYWGQGTQVTVSG

SEQ ID NO: 63 - protein, 118 aa, Vicugna pacos
QVQLVESGGGLVQPGGSLRLSCAASGFTFDVYGMSWVRHSPGKGLEWVSTINWNGGSTYYAESMKGRFTISRDNAKNTVYLQMNSLKPEDTAVYYCAKFAPWDGDMEWGQGTQVTVSG

SEQ ID NO: 64 - protein, 469 aa, Artificial Sequence
  an artificially synthesized sequence
QVQLVESGGGLVQPGGSLRLSCAASGFTFNHCWMYWVRQAPGKGLEWVSVINTDGGSAYYADSVKGRFTISRDNAKNTLYLQMNSLKSEDTAVYYCARDWAPLVDYYYGMDYWGKGTLVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 65 - protein, 467 aa, Artificial Sequence
  an artificially synthesized sequence
QVQLVESGGGLVQPGGSLRLSCAASGFPFDNYVMSWVRQAPGKGLEWISAISWNGGSTYYAESMKGRFTISRDNAKSTLYLQMNSLKSEDTAVYYCAKEPRVYYSGSPDYWGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 66 - protein, 464 aa, Artificial Sequence
  an artificially synthesized sequence
QVQLVESGGGLVQPGGSLRLSCAASGFTFDVYGMSWVRHSPGKGLEWVSTINWNGGSTYYAESMKGRFTISRDNAKNTVYLQMNSLKPEDTAVYYCAKFAPWDGDMEWGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 67 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVELSGRSDNHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEILSGRSDNHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKLSGRSDNHRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTLSGRSDNHVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVLSGRSDNHAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVALSGRSDNHAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 222 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAALSGRSDNHPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 12 aa, Artificial Sequence
  an artificially synthesized sequence
TSTSGRSANPRG

SEQ ID NO: 75 - protein, 13 aa, Artificial Sequence
  an artificially synthesized sequence
ISSGLLSGRSDNH

SEQ ID NO: 76 - protein, 18 aa, Artificial Sequence
  an artificially synthesized sequence
AVGLLAPPGGLSGRSDNH

SEQ ID NO: 77 - protein, 13 aa, Artificial Sequence
  an artificially synthesized sequence
GAGVPMSMRGGAG

SEQ ID NO: 78 - protein, 13 aa, Artificial Sequence
  an artificially synthesized sequence
GAGIPVSLRSGAG

SEQ ID NO: 79 - protein, 8 aa, Artificial Sequence
  an artificially synthesized sequence
GPLGIAGQ

SEQ ID NO: 80 - protein, 10 aa, Artificial Sequence
  an artificially synthesized sequence
GGPLGMLSQS

SEQ ID NO: 81 - protein, 6 aa, Artificial Sequence
  an artificially synthesized sequence
PLGLWA

SEQ ID NO: 82 - protein, 13 aa, Artificial Sequence
  an artificially synthesized sequence
GAGRPFSMIMGAG

SEQ ID NO: 83 - protein, 13 aa, Artificial Sequence
  an artificially synthesized sequence
GAGVPLSLTMGAG

SEQ ID NO: 84 - protein, 13 aa, Artificial Sequence
  an artificially synthesized sequence
GAGVPLSLYSGAG

SEQ ID NO: 85 - protein, 6 aa, Artificial Sequence
  an artificially synthesized sequence
AANLRN

SEQ ID NO: 86 - protein, 6 aa, Artificial Sequence
  an artificially synthesized sequence
AQAYVK

SEQ ID NO: 87 - protein, 6 aa, Artificial Sequence
  an artificially synthesized sequence
AANYMR

SEQ ID NO: 88 - protein, 6 aa, Artificial Sequence
  an artificially synthesized sequence
AAALTR

SEQ ID NO: 89 - protein, 6 aa, Artificial Sequence
  an artificially synthesized sequence
AQNLMR

SEQ ID NO: 90 - protein, 6 aa, Artificial Sequence
  an artificially synthesized sequence
AANYTK

SEQ ID NO: 91 - protein, 16 aa, Artificial Sequence
  an artificially synthesized sequence
GAGPQGLAGQRGIVAG

SEQ ID NO: 92 - protein, 8 aa, Artificial Sequence
  an artificially synthesized sequence
PRFKIIGG

SEQ ID NO: 93 - protein, 8 aa, Artificial Sequence
  an artificially synthesized sequence
PRFRIIGG

SEQ ID NO: 94 - protein, 9 aa, Artificial Sequence
  an artificially synthesized sequence
GAGSGRSAG

SEQ ID NO: 95 - protein, 5 aa, Artificial Sequence
  an artificially synthesized sequence
SGRSA

SEQ ID NO: 96 - protein, 6 aa, Artificial Sequence
  an artificially synthesized sequence
GSGRSA

SEQ ID NO: 97 - protein, 5 aa, Artificial Sequence
  an artificially synthesized sequence
SGKSA

SEQ ID NO: 98 - protein, 5 aa, Artificial Sequence
  an artificially synthesized sequence
SGRSS

SEQ ID NO: 99 - protein, 5 aa, Artificial Sequence
  an artificially synthesized sequence
SGRRA

SEQ ID NO: 100 - protein, 5 aa, Artificial Sequence
  an artificially synthesized sequence
SGRNA

SEQ ID NO: 101 - protein, 5 aa, Artificial Sequence
  an artificially synthesized sequence
SGRKA

SEQ ID NO: 102 - protein, 6 aa, Artificial Sequence
  an artificially synthesized sequence
QRGRSA

SEQ ID NO: 103 - protein, 17 aa, Artificial Sequence
  an artificially synthesized sequence
GAGSLLKSRMVPNFNAG

SEQ ID NO: 104 - protein, 6 aa, Artificial Sequence
  an artificially synthesized sequence
TQGAAA

SEQ ID NO: 105 - protein, 6 aa, Artificial Sequence
  an artificially synthesized sequence
GAAAAA

SEQ ID NO: 106 - protein, 6 aa, Artificial Sequence
  an artificially synthesized sequence
GAGAAG

SEQ ID NO: 107 - protein, 6 aa, Artificial Sequence
  an artificially synthesized sequence
AAAAAG

SEQ ID NO: 108 - protein, 6 aa, Artificial Sequence
  an artificially synthesized sequence
LCGAAI

SEQ ID NO: 109 - protein, 6 aa, Artificial Sequence
  an artificially synthesized sequence
FAQALG

SEQ ID NO: 110 - protein, 6 aa, Artificial Sequence
  an artificially synthesized sequence
LLQANP

SEQ ID NO: 111 - protein, 6 aa, Artificial Sequence
  an artificially synthesized sequence
LAAANP

SEQ ID NO: 112 - protein, 6 aa, Artificial Sequence
  an artificially synthesized sequence
LYGAQF

SEQ ID NO: 113 - protein, 6 aa, Artificial Sequence
  an artificially synthesized sequence
LSQAQG

SEQ ID NO: 114 - protein, 6 aa, Artificial Sequence
  an artificially synthesized sequence
ASAASG

SEQ ID NO: 115 - protein, 6 aa, Artificial Sequence
  an artificially synthesized sequence
FLGASL

SEQ ID NO: 116 - protein, 6 aa, Artificial Sequence
  an artificially synthesized sequence
AYGATG

SEQ ID NO: 117 - protein, 6 aa, Artificial Sequence
  an artificially synthesized sequence
LAQATG

SEQ ID NO: 118 - protein, 17 aa, Artificial Sequence
  an artificially synthesized sequence
GAGSGVVIATVIVITAG

SEQ ID NO: 119 - protein, 8 aa, Artificial Sequence
  an artificially synthesized sequence
APMAEGGG

SEQ ID NO: 120 - protein, 8 aa, Artificial Sequence
  an artificially synthesized sequence
EAQGDKII

SEQ ID NO: 121 - protein, 8 aa, Artificial Sequence
  an artificially synthesized sequence
LAFSDAGP

SEQ ID NO: 122 - protein, 7 aa, Artificial Sequence
  an artificially synthesized sequence
YVADAPK

SEQ ID NO: 123 - protein, 5 aa, Artificial Sequence
  an artificially synthesized sequence
RRRRR

SEQ ID NO: 124 - protein, 6 aa, Artificial Sequence
  an artificially synthesized sequence
RRRRRR

SEQ ID NO: 125 - protein, 10 aa, Artificial Sequence
  an artificially synthesized sequence
GQSSRHRRAL

SEQ ID NO: 126 - protein, 9 aa, Artificial Sequence
  an artificially synthesized sequence
SSRHRRALD

SEQ ID NO: 127 - protein, 14 aa, Artificial Sequence
  an artificially synthesized sequence
RKSSIIIRMRDVVL

SEQ ID NO: 128 - protein, 15 aa, Artificial Sequence
  an artificially synthesized sequence
SSSFDKGKYKKGDDA

SEQ ID NO: 129 - protein, 15 aa, Artificial Sequence
  an artificially synthesized sequence
SSSFDKGKYKRGDDA

SEQ ID NO: 130 - protein, 4 aa, Artificial Sequence
  an artificially synthesized sequence
IEGR

SEQ ID NO: 131 - protein, 4 aa, Artificial Sequence
  an artificially synthesized sequence
IDGR

SEQ ID NO: 132 - protein, 7 aa, Artificial Sequence
  an artificially synthesized sequence
GGSIDGR

SEQ ID NO: 133 - protein, 8 aa, Artificial Sequence
  an artificially synthesized sequence
GPQGIAGQ

SEQ ID NO: 134 - protein, 8 aa, Artificial Sequence
  an artificially synthesized sequence
GPQGLLGA

SEQ ID NO: 135 - protein, 5 aa, Artificial Sequence
  an artificially synthesized sequence
GIAGQ

SEQ ID NO: 136 - protein, 7 aa, Artificial Sequence
  an artificially synthesized sequence
GPLGIAG

SEQ ID NO: 137 - protein, 8 aa, Artificial Sequence
  an artificially synthesized sequence
GPEGLRVG

SEQ ID NO: 138 - protein, 8 aa, Artificial Sequence
  an artificially synthesized sequence
YGAGLGVV

SEQ ID NO: 139 - protein, 8 aa, Artificial Sequence
  an artificially synthesized sequence
AGLGVVER

SEQ ID NO: 140 - protein, 8 aa, Artificial Sequence
  an artificially synthesized sequence
AGLGISST

SEQ ID NO: 141 - protein, 8 aa, Artificial Sequence
  an artificially synthesized sequence
EPQALAMS

SEQ ID NO: 142 - protein, 8 aa, Artificial Sequence
  an artificially synthesized sequence
QALAMSAI

SEQ ID NO: 143 - protein, 8 aa, Artificial Sequence
  an artificially synthesized sequence
AAYHLVSQ

SEQ ID NO: 144 - protein, 8 aa, Artificial Sequence
  an artificially synthesized sequence
MDAFLESS

SEQ ID NO: 145 - protein, 8 aa, Artificial Sequence
  an artificially synthesized sequence
ESLPVVAV

SEQ ID NO: 146 - protein, 8 aa, Artificial Sequence
  an artificially synthesized sequence
SAPAVESE

SEQ ID NO: 147 - protein, 8 aa, Artificial Sequence
  an artificially synthesized sequence
DVAQFVLT

SEQ ID NO: 148 - protein, 8 aa, Artificial Sequence
  an artificially synthesized sequence
VAQFVLTE

SEQ ID NO: 149 - protein, 8 aa, Artificial Sequence
  an artificially synthesized sequence
AQFVLTEG

SEQ ID NO: 150 - protein, 8 aa, Artificial Sequence
  an artificially synthesized sequence
PVQPIGPQ

SEQ ID NO: 151 - protein, 6 aa, Artificial Sequence
  an artificially synthesized sequence
LVPRGS

SEQ ID NO: 152 - protein, 214 aa, Artificial Sequence
  an artificially synthesized sequence
DIQMTQSPSSLSASVGDRVTITCRASQSISSYLNWYQQKPGKAPKLLIYAASSLQSGVPSRFSGSGSGTDFTLTISSLQPEDFATYYCLQFDSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEA

SEQ ID NO: 153 - protein, 107 aa, Artificial Sequence
  an artificially synthesized sequence
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEA

SEQ ID NO: 154 - protein, 464 aa, Artificial Sequence
  an artificially synthesized sequence
QLQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWDSRGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 155 - protein, 464 aa, Artificial Sequence
  an artificially synthesized sequence
QVQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWDSRGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 156 - protein, 464 aa, Artificial Sequence
  an artificially synthesized sequence
QVQLVESGGGLVQPGGSLRLSCTASGISFSISTMGWYRQAPGKQRELVATITSGGEAYYANSMKDRFTISRDNAENTVYLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 157 - protein, 464 aa, Artificial Sequence
  an artificially synthesized sequence
QLQLVESGGGLVQPGGSLRLSCTASGISFSISTMGWYRQAPGKQRELVATIASGGEAYYANSVKGRFTISRDNAENTVYLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 158 - protein, 464 aa, Artificial Sequence
  an artificially synthesized sequence
QLQLVESGGGLVQPGGSLRLSCTASGISFSISTMGWYRQAPGKQRELVATIASGGEAYYANSVKGRFTISREYAENTVFLQMNRLKPEDSAVYYCNTKFPWSTDWNARGQGTQVTVSGGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 159 - protein, 116 aa, Artificial Sequence
  an artificially synthesized sequence
QVQLVQSGGGLVQPGGSLRLSCAASYFDFDSYEMSWVRQAPGKGLEWIGSIYHSGSTYYNPSLKSRVTISRDNSKNTLYLQMNTLRAEDTATYYCARVNMDRFDYWGQGTLVTVSS

SEQ ID NO: 160 - protein, 124 aa, Artificial Sequence
  an artificially synthesized sequence
EVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSS

SEQ ID NO: 161 - protein, 354 aa, Artificial Sequence
  an artificially synthesized sequence
GSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 162 - protein, 629 aa, Artificial Sequence
  an artificially synthesized sequence
QVQLVQSGGGLVQPGGSLRLSCAASYFDFDSYEMSWVRQAPGKGLEWIGSIYHSGSTYYNPSLKSRVTISRDNSKNTLYLQMNTLRAEDTATYYCARVNMDRFDYWGQGTLVTVSSGGGGSGGGGSGGGGSGGGGSGGGGSGGGGSGGGGSEVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 163 - protein, 118 aa, Artificial Sequence
  an artificially synthesized sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTLVTVSS

SEQ ID NO: 164 - protein, 631 aa, Artificial Sequence
  an artificially synthesized sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTLVTVSSGGGGSGGGGSGGGGSGGGGSGGGGSGGGGSGGGGSEVQLVESGGGPVQAGGSLRLSCAASGRTYRGYSMGWFRQAPGKEREFVAAIVWSGGNTYYEDSVKGRFTISRDNAKNTMYLQMTSLKPEDSATYYCAAKIRPYIFKIAGQYDYWGQGTLVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCEMTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 165 - protein, 468 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGIPVSLRSGAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 166 - protein, 230 aa, Artificial Sequence
  an artificially synthesized sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 167 - protein, 455 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 168-177 - skipped (10 entries)

SEQ ID NO: 178 - protein, 12 aa, Artificial Sequence
  an artificially synthesized sequence
TSTSGRSANPRG

SEQ ID NO: 179-188 - skipped (10 entries)

SEQ ID NO: 189 - protein, 467 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 190 - protein, 127 aa, Artificial Sequence
  an artificially synthesized sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSS

SEQ ID NO: 191 - protein, 455 aa, Artificial Sequence
  an artificially synthesized sequence
EVQLVESGGGLVQPGGSLRLSCAASGFTFSDYDIGWFRQAPGKGREGVSGISSSDGNTYYADSVKGRFTISRDNAKNTLYLQMNSLRPEDTAVYYCAAEPPDSSWYLDGSPEFFKYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 192 - protein, 455 aa, Artificial Sequence
  an artificially synthesized sequence
EVQLVESGGGLVQPGGSLRLSCAASGFTFSDYDIGWVRQAPGKGLEWVSGISSSDGNTYYADSVKGRFTISRDNAKNTLYLQMNSLRPEDTAVYYCAAEPPDSSWYLDGSPEFFKYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 193 - protein, 16 aa, Artificial Sequence
  an artificially synthesized sequence
GGGGSPLGLAGGGGGS

SEQ ID NO: 194 - protein, 18 aa, Artificial Sequence
  an artificially synthesized sequence
GGGGSGPLGIAGQGGGGS

SEQ ID NO: 195 - protein, 23 aa, Artificial Sequence
  an artificially synthesized sequence
GGGGSGAGVPLSLYSGAGGGGGS

SEQ ID NO: 196 - protein, 471 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSPLGLAGGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 197 - protein, 473 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSGPLGIAGQGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 198 - protein, 478 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGGGSGAGVPLSLYSGAGGGGGSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 199 - protein, 8 aa, Artificial Sequence
  an artificially synthesized sequence
DYKDDDDK

SEQ ID NO: 200 - protein, 1267 aa, Artificial Sequence
  an artificially synthesized sequence
MWWRLWWLLLLLLLLWPMVWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPDYKDDDDKGGGGSGLNDIFEAQKIEWHE

SEQ ID NO: 201 - protein, 347 aa, Artificial Sequence
  an artificially synthesized sequence
MVLASSTTSIHTMLLLLLMLAQPAMAMKDNTVPLKLIALLANGEFHSGEQLGETLGMSRAAINKHIQTLRDWGVDVFTVPGKGYSLPEPIQLLNAKQILGQLDGGSVAVLPVIDSTNQYLLDRIGELKSGDACIAEYQQAGRGRRGRKWFSPFGANLYLSMFWRLEQGPAAAIGLSLVIGIVMAEVLRKLGADKVRVKWPNDLYLQDRKLAGILVELTGKTGDAAQIVIGAGINMAMRRVEESVVNQGWITLQEAGINLDRNTLAAMLIRELRAALELFEQEGLAPYLSRWEKLDNFINRPVKLIIGDKEIFGISRGIDKQGALLLEQDGIIKPWMGGEISLRSAEK

SEQ ID NO: 202 - protein, 463 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGPLGIAGQSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 203 - protein, 465 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGGPLGMLSQSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 204 - protein, 461 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAPLGLWASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 205 - protein, 463 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAVPLSLTMGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 206 - protein, 468 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGVPLSLTMGAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 207 - protein, 471 aa, Artificial Sequence
  an artificially synthesized sequence
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSAGAGPQGLAGQRGIVAGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 208 - protein, 447 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 209 - protein, 214 aa, Artificial Sequence [sequence omitted]

SEQ ID NO: 210 - protein, 12 aa, Artificial Sequence
  an artificially synthesized sequence
TSTSGRSANPRG

SEQ ID NO: 211 - protein, 119 aa, Artificial Sequence [sequence omitted]

SEQ ID NO: 212 - protein, 328 aa, Artificial Sequence
  an artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 213 - protein, 131 aa, Artificial Sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 214 - protein, 131 aa, Artificial Sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 215 - protein, 131 aa, Artificial Sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 216 - protein, 131 aa, Artificial Sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 217 - protein, 131 aa, Artificial Sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 218 - protein, 131 aa, Artificial Sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 219 - protein, 131 aa, Artificial Sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 220 - protein, 131 aa, Artificial Sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 221 - protein, 131 aa, Artificial Sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 222 - protein, 131 aa, Artificial Sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSS

SEQ ID NO: 223 - protein, 131 aa, Artificial Sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSS

SEQ ID NO: 224 - protein, 131 aa, Artificial Sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSS

SEQ ID NO: 225 - protein, 131 aa, Artificial Sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSS

SEQ ID NO: 226 - protein, 131 aa, Artificial Sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSS

SEQ ID NO: 227 - protein, 131 aa, Artificial Sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSS

SEQ ID NO: 228 - protein, 131 aa, Artificial Sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSS

SEQ ID NO: 229 - protein, 131 aa, Artificial Sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSS

SEQ ID NO: 230 - protein, 131 aa, Artificial Sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSS

SEQ ID NO: 231 - protein, 131 aa, Artificial Sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSS

SEQ ID NO: 232 - protein, 131 aa, Artificial Sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSS

SEQ ID NO: 233 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSS

SEQ ID NO: 234 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSS

SEQ ID NO: 235 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSS

SEQ ID NO: 236 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSS

SEQ ID NO: 237 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSS

SEQ ID NO: 238 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSS

SEQ ID NO: 239 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSS

SEQ ID NO: 240 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSS

SEQ ID NO: 241 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSS

SEQ ID NO: 242 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSS

SEQ ID NO: 243 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSS

SEQ ID NO: 244 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSS

SEQ ID NO: 245 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSS

SEQ ID NO: 246 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSS

SEQ ID NO: 247 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSS

SEQ ID NO: 248 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSS

SEQ ID NO: 249 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSS

SEQ ID NO: 250 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSS

SEQ ID NO: 251 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSS

SEQ ID NO: 252 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSS

SEQ ID NO: 253 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSS

SEQ ID NO: 254 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSS

SEQ ID NO: 255 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSS

SEQ ID NO: 256 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSS

SEQ ID NO: 257 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSS

SEQ ID NO: 258 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSS

SEQ ID NO: 259 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSS

SEQ ID NO: 260 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSS

SEQ ID NO: 261 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSS

SEQ ID NO: 262 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSS

SEQ ID NO: 263 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGS

SEQ ID NO: 264 - protein, 131 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRG

SEQ ID NO: 265 - protein, 340 aa, Artificial Sequence
  an artificially synthesized sequence
ATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 266 - protein, 340 aa, Artificial Sequence
  an artificially synthesized sequence
ASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 267 - protein, 340 aa, Artificial Sequence
  an artificially synthesized sequence
ASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 268 - protein, 340 aa, Artificial Sequence
  an artificially synthesized sequence
ASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 269 - protein, 340 aa, Artificial Sequence
  an artificially synthesized sequence
ASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 270 - protein, 340 aa, Artificial Sequence
  an artificially synthesized sequence
ASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 271 - protein, 340 aa, Artificial Sequence
  an artificially synthesized sequence
ASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 272 - protein, 340 aa, Artificial Sequence
  an artificially synthesized sequence
ASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 273 - protein, 340 aa, Artificial Sequence
  an artificially synthesized sequence
ASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 274 - protein, 340 aa, Artificial Sequence
  an artificially synthesized sequence
ASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 275 - protein, 340 aa, Artificial Sequence
  an artificially synthesized sequence
ASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 276 - protein, 340 aa, Artificial Sequence
  an artificially synthesized sequence
ASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 277 - protein, 340 aa, Artificial Sequence
  an artificially synthesized sequence
ASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 278 - protein, 340 aa, Artificial Sequence
  an artificially synthesized sequence
ASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 279 - protein, 340 aa, Artificial Sequence
  an artificially synthesized sequence
ASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 280 - protein, 107 aa, Artificial Sequence [sequence omitted]

SEQ ID NO: 281 - protein, 107 aa, Artificial Sequence [sequence omitted]

SEQ ID NO: 282 - protein, 119 aa, Artificial Sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 283 - protein, 119 aa, Artificial Sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 284 - protein, 119 aa, Artificial Sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 285 - protein, 119 aa, Artificial Sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 286 - protein, 119 aa, Artificial Sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 287 - protein, 119 aa, Artificial Sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 288 - protein, 119 aa, Artificial Sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 289 - protein, 119 aa, Artificial Sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 290 - protein, 119 aa, Artificial Sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 291 - protein, 119 aa, Artificial Sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 292 - protein, 119 aa, Artificial Sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 293 - protein, 119 aa, Artificial Sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 294 - protein, 119 aa, Artificial Sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIK

SEQ ID NO: 295 - protein, 119 aa, Artificial Sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIK

SEQ ID NO: 296 - protein, 119 aa, Artificial Sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIK

SEQ ID NO: 297 - protein, 119 aa, Artificial Sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIK

SEQ ID NO: 298 - protein, 119 aa, Artificial Sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIK

SEQ ID NO: 299 - protein, 119 aa, Artificial Sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIK

SEQ ID NO: 300 - protein, 119 aa, Artificial Sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIK

SEQ ID NO: 301 - protein, 119 aa, Artificial Sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIK

SEQ ID NO: 302 - protein, 119 aa, Artificial Sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIK

SEQ ID NO: 303 - protein, 119 aa, Artificial Sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIK

SEQ ID NO: 304 - protein, 119 aa, Artificial Sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIK

SEQ ID NO: 305 - protein, 119 aa, Artificial Sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIK

SEQ ID NO: 306 - protein, 119 aa, Artificial Sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIK

SEQ ID NO: 307 - protein, 119 aa, Artificial Sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIK

SEQ ID NO: 308 - protein, 119 aa, Artificial Sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIK

SEQ ID NO: 309 - protein, 119 aa, Artificial Sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIK

SEQ ID NO: 310 - protein, 119 aa, Artificial Sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIK

SEQ ID NO: 311 - protein, 119 aa, Artificial Sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIK

SEQ ID NO: 312 - protein, 119 aa, Artificial Sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIK

SEQ ID NO: 313 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIK

SEQ ID NO: 314 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIK

SEQ ID NO: 315 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIK

SEQ ID NO: 316 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIK

SEQ ID NO: 317 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIK

SEQ ID NO: 318 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIK

SEQ ID NO: 319 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIK

SEQ ID NO: 320 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIK

SEQ ID NO: 321 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIK

SEQ ID NO: 322 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIK

SEQ ID NO: 323 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGK

SEQ ID NO: 324 - protein, 119 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRG

SEQ ID NO: 325 - protein, 119 aa, Artificial Sequence
  an artificially synthesized sequence
RTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 119 aa, Artificial Sequence
  an artificially synthesized sequence
RTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 119 aa, Artificial Sequence
  an artificially synthesized sequence
RTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 119 aa, Artificial Sequence
  an artificially synthesized sequence
RTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 119 aa, Artificial Sequence
  an artificially synthesized sequence
RTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 119 aa, Artificial Sequence
  an artificially synthesized sequence
RTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 119 aa, Artificial Sequence
  an artificially synthesized sequence
RTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 119 aa, Artificial Sequence
  an artificially synthesized sequence
RTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 119 aa, Artificial Sequence
  an artificially synthesized sequence
RTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 119 aa, Artificial Sequence
  an artificially synthesized sequence
RTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - protein, 119 aa, Artificial Sequence
  an artificially synthesized sequence
RTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 119 aa, Artificial Sequence
  an artificially synthesized sequence
RTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 119 aa, Artificial Sequence
  an artificially synthesized sequence
RTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 119 aa, Artificial Sequence
  an artificially synthesized sequence
RTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 119 aa, Artificial Sequence
  an artificially synthesized sequence
RTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 119 aa, Artificial Sequence
  an artificially synthesized sequence
RTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - protein, 119 aa, Artificial Sequence
  an artificially synthesized sequence
RTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 119 aa, Artificial Sequence
  an artificially synthesized sequence
RTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 343 - protein, 119 aa, Artificial Sequence
  an artificially synthesized sequence
RTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - protein, 119 aa, Artificial Sequence
  an artificially synthesized sequence
RTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - protein, 119 aa, Artificial Sequence
  an artificially synthesized sequence
RTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 346 - protein, 119 aa, Artificial Sequence
  an artificially synthesized sequence
RTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 459 aa, Artificial Sequence
  an artificially synthesized sequence
QVQLQESTSTSGRSANPRGGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 348 - protein, 459 aa, Artificial Sequence
  an artificially synthesized sequence
QVQLQESGTSTSGRSANPRGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 349 - protein, 459 aa, Artificial Sequence
  an artificially synthesized sequence
QVQLQESGPTSTSGRSANPRGGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 350 - protein, 459 aa, Artificial Sequence
  an artificially synthesized sequence
QVQLQESGPGTSTSGRSANPRGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 351 - protein, 459 aa, Artificial Sequence
  an artificially synthesized sequence
QVQLQESGPGLTSTSGRSANPRGVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 352 - protein, 459 aa, Artificial Sequence
  an artificially synthesized sequence
QVQLQESGPGLVTSTSGRSANPRGRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 353 - protein, 459 aa, Artificial Sequence
  an artificially synthesized sequence
QVQLQESGPGLVRTSTSGRSANPRGPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 354 - protein, 459 aa, Artificial Sequence
  an artificially synthesized sequence
QVQLQESGPGLVRPTSTSGRSANPRGSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 355 - protein, 459 aa, Artificial Sequence
  an artificially synthesized sequence
QVQLQESGPGLVRPSTSTSGRSANPRGQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 356 - protein, 459 aa, Artificial Sequence
  an artificially synthesized sequence
QVQLQESGPGLVRPSQTLSLTCTVSGYSITSDHAWSWVRQPTSTSGRSANPRGPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 357 - protein, 459 aa, Artificial Sequence
  an artificially synthesized sequence
QVQLQESGPGLVRPSQTLSLTCTVSGYSITSDHAWSWVRQPPTSTSGRSANPRGGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 358 - protein, 459 aa, Artificial Sequence
  an artificially synthesized sequence
QVQLQESGPGLVRPSQTLSLTCTVSGYSITSDHAWSWVRQPPGTSTSGRSANPRGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 359 - protein, 459 aa, Artificial Sequence
  an artificially synthesized sequence
QVQLQESGPGLVRPSQTLSLTCTVSGYSITSDHAWSWVRQPPGRTSTSGRSANPRGGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 360 - protein, 459 aa, Artificial Sequence
  an artificially synthesized sequence
QVQLQESGPGLVRPSQTLSLTCTVSGYSITSDHAWSWVRQPPGRGTSTSGRSANPRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 361 - protein, 459 aa, Artificial Sequence
  an artificially synthesized sequence
QVQLQESGPGLVRPSQTLSLTCTVSGYSITSDHAWSWVRQPPGRGLTSTSGRSANPRGEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 362 - protein, 459 aa, Artificial Sequence
  an artificially synthesized sequence
QVQLQESGPGLVRPSQTLSLTCTVSGYSITSDHAWSWVRQPPGRGLEWIGYISYSGTSTSGRSANPRGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 363 - protein, 459 aa, Artificial Sequence
  an artificially synthesized sequence
QVQLQESGPGLVRPSQTLSLTCTVSGYSITSDHAWSWVRQPPGRGLEWIGYISYSGITSTSGRSANPRGTTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 364 - protein, 459 aa, Artificial Sequence
  an artificially synthesized sequence
QVQLQESGPGLVRPSQTLSLTCTVSGYSITSDHAWSWVRQPPGRGLEWIGYISYSGITTSTSGRSANPRGTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 365 - protein, 459 aa, Artificial Sequence
  an artificially synthesized sequence
QVQLQESGPGLVRPSQTLSLTCTVSGYSITSDHAWSWVRQPPGRGLEWIGYISYSGITTTSTSGRSANPRGYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 366 - protein, 459 aa, Artificial Sequence
  an artificially synthesized sequence
QVQLQESGPGLVRPSQTLSLTCTVSGYSITSDHAWSWVRQPPGRGLEWIGYISYSGITTYTSTSGRSANPRGNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 367 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNTSTSGRSANPRGPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 368 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPTSTSGRSANPRGSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 369 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSTSTSGRSANPRGLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 370 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLTSTSGRSANPRGKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 371 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKTSTSGRSANPRGSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 372 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSTSTSGRSANPRGRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 373 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRTSTSGRSANPRGVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 374 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTSTSGRSANPRGTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 375 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTTSTSGRSANPRGMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 376 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTTSTSGRSANPRGSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 377 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSTSTSGRSANPRGKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 378 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKTSTSGRSANPRGNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 379 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNTSTSGRSANPRGQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 380 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQTSTSGRSANPRGFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 381 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTTSTSGRSANPRGAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 382 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTATSTSGRSANPRGADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 383 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAATSTSGRSANPRGDTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 384 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSTSTSGRSANPRGLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 385 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLTSTSGRSANPRGARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 386 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLATSTSGRSANPRGRTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 387 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTSTSGRSANPRGTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 388 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWTSTSGRSANPRGGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 389 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGTSTSGRSANPRGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 390 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQTSTSGRSANPRGGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 391 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGTSTSGRSANPRGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 392 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSTSTSGRSANPRGLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 393 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLTSTSGRSANPRGVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 394 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTSTSGRSANPRGTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 395 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTTSTSGRSANPRGVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 396 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVTSTSGRSANPRGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 397 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSTSTSGRSANPRGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 398 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSTSTSGRSANPRGASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 399 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSATSTSGRSANPRGSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 400 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTSTSGRSANPRGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 401 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTTSTSGRSANPRGKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 402 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKTSTSGRSANPRGGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 403 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGTSTSGRSANPRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 404 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPTSTSGRSANPRGSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 405 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSTSTSGRSANPRGVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 406 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLATSTSGRSANPRGPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 407 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPTSTSGRSANPRGSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 408 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSTSTSGRSANPRGSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 409 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSTSTSGRSANPRGKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 410 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSTSGRSANPRGTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 411 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTTSTSGRSANPRGSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 412 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGTSTSGRSANPRGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 413 - protein, 459 aa, Artificial Sequence
  an artificially synthesized sequence
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTTSTSGRSANPRGAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 414 - protein, 226 aa, Artificial Sequence
  an artificially synthesized sequence
DIQMTQSTSTSGRSANPRGPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 415 - protein, 226 aa, Artificial Sequence
  an artificially synthesized sequence
DIQMTQSPTSTSGRSANPRGSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 226 aa, Artificial Sequence
  an artificially synthesized sequence
DIQMTQSPSTSTSGRSANPRGSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 226 aa, Artificial Sequence
  an artificially synthesized sequence
DIQMTQSPSSTSTSGRSANPRGLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - protein, 226 aa, Artificial Sequence
  an artificially synthesized sequence
DIQMTQSPSSLTSTSGRSANPRGSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 226 aa, Artificial Sequence
  an artificially synthesized sequence
DIQMTQSPSSLSTSTSGRSANPRGASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 226 aa, Artificial Sequence
  an artificially synthesized sequence
DIQMTQSPSSLSATSTSGRSANPRGSVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 421 - protein, 226 aa, Artificial Sequence
  an artificially synthesized sequence
DIQMTQSPSSLSASTSTSGRSANPRGVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 226 aa, Artificial Sequence
  an artificially synthesized sequence
DIQMTQSPSSLSASVTSTSGRSANPRGGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 423 - protein, 226 aa, Artificial Sequence
  an artificially synthesized sequence
DIQMTQSPSSLSASVGTSTSGRSANPRGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 424 - protein, 226 aa, Artificial Sequence
  an artificially synthesized sequence
DIQMTQSPSSLSASVGDTSTSGRSANPRGRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 226 aa, Artificial Sequence
  an artificially synthesized sequence
DIQMTQSPSSLSASVGDRTSTSGRSANPRGVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 426 - protein, 226 aa, Artificial Sequence
  an artificially synthesized sequence
DIQMTQSPSSLSASVGDRVTITCRASQDISSYLNWYQQKTSTSGRSANPRGPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 427 - protein, 226 aa, Artificial Sequence
  an artificially synthesized sequence
DIQMTQSPSSLSASVGDRVTITCRASQDISSYLNWYQQKPTSTSGRSANPRGGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 428 - protein, 226 aa, Artificial Sequence
  an artificially synthesized sequence
DIQMTQSPSSLSASVGDRVTITCRASQDISSYLNWYQQKPGTSTSGRSANPRGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 429 - protein, 226 aa, Artificial Sequence
  an artificially synthesized sequence
DIQMTQSPSSLSASVGDRVTITCRASQDISSYLNWYQQKPGKTSTSGRSANPRGAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 430 - protein, 226 aa, Artificial Sequence
  an artificially synthesized sequence
DIQMTQSPSSLSASVGDRVTITCRASQDISSYLNWYQQKPGKATSTSGRSANPRGPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 431 - protein, 226 aa, Artificial Sequence
  an artificially synthesized sequence
DIQMTQSPSSLSASVGDRVTITCRASQDISSYLNWYQQKPGKAPTSTSGRSANPRGKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 432 - protein, 226 aa, Artificial Sequence
  an artificially synthesized sequence
DIQMTQSPSSLSASVGDRVTITCRASQDISSYLNWYQQKPGKAPKTSTSGRSANPRGLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - protein, 226 aa, Artificial Sequence
  an artificially synthesized sequence
DIQMTQSPSSLSASVGDRVTITCRASQDISSYLNWYQQKPGKAPKLLIYTSTSGRSANPRGYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 434 - protein, 226 aa, Artificial Sequence
  an artificially synthesized sequence
DIQMTQSPSSLSASVGDRVTITCRASQDISSYLNWYQQKPGKAPKLLIYYTSTSGRSANPRGTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 435 - protein, 226 aa, Artificial Sequence
  an artificially synthesized sequence
DIQMTQSPSSLSASVGDRVTITCRASQDISSYLNWYQQKPGKAPKLLIYYTTSTSGRSANPRGSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 436 - protein, 226 aa, Artificial Sequence
  an artificially synthesized sequence
DIQMTQSPSSLSASVGDRVTITCRASQDISSYLNWYQQKPGKAPKLLIYYTSTSTSGRSANPRGRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 437 - protein, 226 aa, Artificial Sequence
  an artificially synthesized sequence
DIQMTQSPSSLSASVGDRVTITCRASQDISSYLNWYQQKPGKAPKLLIYYTSRTSTSGRSANPRGLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 438 - protein, 226 aa, Artificial Sequence
  an artificially synthesized sequence
DIQMTQSPSSLSASVGDRVTITCRASQDISSYLNWYQQKPGKAPKLLIYYTSRLTSTSGRSANPRGHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 439 - protein, 226 aa, Artificial Sequence
  an artificially synthesized sequence
DIQMTQSPSSLSASVGDRVTITCRASQDISSYLNWYQQKPGKAPKLLIYYTSRLHTSTSGRSANPRGSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 440 - protein, 226 aa, Artificial Sequence
  an artificially synthesized sequence
DIQMTQSPSSLSASVGDRVTITCRASQDISSYLNWYQQKPGKAPKLLIYYTSRLHSTSTSGRSANPRGGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 441 - protein, 226 aa, Artificial Sequence
  an artificially synthesized sequence
DIQMTQSPSSLSASVGDRVTITCRASQDISSYLNWYQQKPGKAPKLLIYYTSRLHSGTSTSGRSANPRGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 442 - protein, 226 aa, Artificial Sequence
  an artificially synthesized sequence
DIQMTQSPSSLSASVGDRVTITCRASQDISSYLNWYQQKPGKAPKLLIYYTSRLHSGVTSTSGRSANPRGPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 226 aa, Artificial Sequence
  an artificially synthesized sequence
DIQMTQSPSSLSASVGDRVTITCRASQDISSYLNWYQQKPGKAPKLLIYYTSRLHSGVPTSTSGRSANPRGSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 444 - protein, 226 aa, Artificial Sequence
  an artificially synthesized sequence
DIQMTQSPSSLSASVGDRVTITCRASQDISSYLNWYQQKPGKAPKLLIYYTSRLHSGVPSTSTSGRSANPRGRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTSTSGRSANPRGTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTTSTSGRSANPRGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 447 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFTSTSGRSANPRGGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGTSTSGRSANPRGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 449 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQTSTSGRSANPRGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTSTSGRSANPRGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 451 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTTSTSGRSANPRGKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKTSTSGRSANPRGVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 453 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVTSTSGRSANPRGEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVETSTSGRSANPRGIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 455 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEITSTSGRSANPRGKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTSTSGRSANPRGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 457 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTSTSGRSANPRGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 458 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTTSTSGRSANPRGVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 459 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVTSTSGRSANPRGAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 460 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVATSTSGRSANPRGAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAATSTSGRSANPRGPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPTSTSGRSANPRGSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVTSTSGRSANPRGFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 464 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFTSTSGRSANPRGIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 465 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFITSTSGRSANPRGFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 466 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFTSTSGRSANPRGPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 467 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPTSTSGRSANPRGPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 468 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPTSTSGRSANPRGSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 469 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSTSTSGRSANPRGDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 470 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDTSTSGRSANPRGEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 471 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDETSTSGRSANPRGQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 472 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQTSTSGRSANPRGLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLTSTSGRSANPRGKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 474 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKTSTSGRSANPRGSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 475 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSTSTSGRSANPRGGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTSTSGRSANPRGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 477 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTTSTSGRSANPRGASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 478 - protein, 226 aa, Artificial Sequence
  an artificially synthesized sequence
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTATSTSGRSANPRGSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - protein, 21 aa, Artificial Sequence
  an artificially synthesized sequence
WPDMELPLPRNITEGEARGSV

SEQ ID NO: 480 - protein, 22 aa, Artificial Sequence
  an artificially synthesized sequence
ITEGEARGSVILTVKPIFEVSP

SEQ ID NO: 481 - protein, 21 aa, Artificial Sequence
  an artificially synthesized sequence
WPDVELPVPRNITEGEARGSV

SEQ ID NO: 482 - protein, 22 aa, Artificial Sequence
  an artificially synthesized sequence
ITEGEARGSVVLTAKPVLDVSP

SEQ ID NO: 483 - protein, 214 aa, Artificial Sequence; identical to SEQ ID NO: 3
  an artificially synthesized sequence

SEQ ID NO: 484 - protein, 219 aa, Artificial Sequence; identical to SEQ ID NO: 4
  an artificially synthesized sequence

SEQ ID NO: 485 - protein, 215 aa, Artificial Sequence; identical to SEQ ID NO: 5
  an artificially synthesized sequence

SEQ ID NO: 486 - protein, 217 aa, Artificial Sequence; identical to SEQ ID NO: 6
  an artificially synthesized sequence

SEQ ID NO: 487 - protein, 216 aa, Artificial Sequence; identical to SEQ ID NO: 7
  an artificially synthesized sequence

SEQ ID NO: 488 - protein, 217 aa, Artificial Sequence; identical to SEQ ID NO: 8
  an artificially synthesized sequence

SEQ ID NO: 489 - protein, 213 aa, Artificial Sequence; identical to SEQ ID NO: 9
  an artificially synthesized sequence

SEQ ID NO: 490 - protein, 346 aa, Artificial Sequence
  an artificially synthesized sequence
GSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 491 - protein, 230 aa, Artificial Sequence
  an artificially synthesized sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 492 - protein, 472 aa, Artificial Sequence
  an artificially synthesized sequence
QLQLVESGGGLVQAGGSLRLSCAASGRTFRTYAMGWFRQAPGKEREFVSSISGSGGSKIYADSVKGRFTISRDNAKDTVNLQMNSLKPEDTAVYYCAVARGYYGTMASDPGLYDYWGQGTQVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 493 - protein, 472 aa, Artificial Sequence
  an artificially synthesized sequence
QLQLVESGGGLVQAGGSLRLSCAASGRTFRTYAMGWVRQAPGKGLEWVSSISGSGGSKIYADSVKGRFTISRDNAKDTVNLQMNSLKPEDTAVYYCAVARGYYGTMASDPGLYDYWGQGTQVTVSSGSGLSGRSDNHGSSGGSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 494 - protein, 18 aa, Artificial Sequence
  an artificially synthesized sequence
GSGLSGRSDNHGSSGGSS

SEQ ID NO: 495 - protein, 21 aa, Artificial Sequence
  an artificially synthesized sequence
CEEDITVQTVTWPDVELPVPR

SEQ ID NO: 496 - protein, 21 aa, Artificial Sequence
  an artificially synthesized sequence
CWPDVELPVPRNITEGEARGS

SEQ ID NO: 497 - protein, 21 aa, Artificial Sequence
  an artificially synthesized sequence
CNITEGEARGSVVLTAKPVLD

SEQ ID NO: 498 - protein, 21 aa, Artificial Sequence
  an artificially synthesized sequence
CVVLTAKPVLDVSPTAPQPEE

SEQ ID NO: 499 - protein, 125 aa, Artificial Sequence
  an artificially synthesized sequence
QLQLVESGGGSGQPGGSLKLSCAASGFDLDYFAVGWFRQAPGKEREGVSCISVSGANISYADSVKGRFTIFRDSAKRTVDLSLDALKPEDTAVYYCATTWGIHWCPLSASEYRRWGRGTQVTVSL

SEQ ID NO: 500 - protein, 125 aa, Artificial Sequence
  an artificially synthesized sequence
QLQLVESGGGSGQPGGSLRLSCAASGFDLDYYAVGWFRQAPGKEREGIACTSVSGANTTYVDTVKGRFTISRDNAKRTVDLSLDSLKPEDTAVYYCATTWGIHWCPLSASEYRRWGRGTQVTVSL

SEQ ID NO: 501 - protein, 126 aa, Artificial Sequence
  an artificially synthesized sequence
QLQLVESGGGLVQAGGSLRLSCAASGRTFRTYAMGWFRQAPGKEREFVSSISGSGGSKIYADSVKGRFTISRDNAKDTVNLQMNSLKPEDTAVYYCAVARGYYGTMASDPGLYDYWGQGTQVTVSS

SEQ ID NO: 502 - protein, 126 aa, Artificial Sequence; identical to SEQ ID NO: 501
  an artificially synthesized sequence

SEQ ID NO: 503 - protein, 125 aa, Artificial Sequence
  an artificially synthesized sequence
QVQLVESGGGSGQPGGSLRLSCAASGFDLDYFAVGWFRQAPGEEREGVACISVSGANITYVDSVKGRFTISRDNAKRTVDLSLDSLKPEDTAVYYCATTWGIHWCPLSASEYRRWGRGTQVTVSS

SEQ ID NO: 504 - protein, 125 aa, Artificial Sequence
  an artificially synthesized sequence
QVQLVESGGGSGQPGGSLRLSCAASGFDLDYYAVGWFRQAPGKEREAVSCISVSGANISYVDSVKGRFTISRDNAKRTVDLSLDSLKPEDTAVYYCATTWGIHWCPLNPSDYRRWGRGTQVTVSS

SEQ ID NO: 505 - protein, 125 aa, Artificial Sequence
  an artificially synthesized sequence
QVQLVESGGGSGQSGGSLTLSCAASGFDLDYYAVGWFRQAPGKEREGVACTSVSGANISYVDSVKGRFTIYRDNVKKTVELSLDSLKPEDTAVYYCATTWGIHWCPLIASEYRRWGRGTQVTVSS

SEQ ID NO: 506 - protein, 241 aa, Artificial Sequence
  an artificially synthesized sequence
EPKTPKPQAAAEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 507 - protein, 23 aa, Artificial Sequence
  an artificially synthesized sequence
ITEGEARGSVILTVKPIFEVSPC

SEQ ID NO: 508 - protein, 23 aa, Artificial Sequence
  an artificially synthesized sequence
ITEGEARGSVVLTAKPVLDVSPC

SEQ ID NO: 509 - protein, 2530 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPQITCTDPTTYKRRLQKRSSRHPRRSRPSTAH

SEQ ID NO: 510 - protein, 110 aa, Artificial Sequence
  an artificially synthesized sequence
QSVEESGGRLVTPGTPLTLTCTVSGVDLSNYAIHWVRQAPGKGLEWIGMIRSNGMRYYGTWAKGRFTTSKTSSTTVDLKMTSPTTEDTATYFCARLWNIWGPGTLVTVSS

SEQ ID NO: 511 - protein, 108 aa, Artificial Sequence
  an artificially synthesized sequence
QVLTQTPSSTSVAVGGTVTINCQSSPSVYLNLLAWYQQKPGQPPKLLIYSASFLQSGVPPRFSGSGSGTQFTLTISGVQCADAATYYCAGVYSNNIYTFGGGTKVEIK

SEQ ID NO: 512 - protein, 110 aa, Artificial Sequence
  an artificially synthesized sequence
QSVEESGGRLVTPGTPLTLTCTVSGVDLSNYAIHWVRQAPGKGLEWIGMIRSNGMIYYATWAKGRFTTSKTSSTTVDLKMTSPTTEDTATYFCARLWNLWGPGTLVTVSS

SEQ ID NO: 513 - protein, 108 aa, Artificial Sequence
  an artificially synthesized sequence
QVLTQTPSSTSVAVGGTVTINCQSSPSVYSNLLAWYQQKPGQPPKLLIYSASALQSGVPPRFSGSGSGTQFTLTISGVQCADAATYYCAGVYSNNIYTFGGGTKVEIK

SEQ ID NO: 514 - protein, 120 aa, Artificial Sequence
  an artificially synthesized sequence
EVKLMESGGGLVKPGGSLKLSCAASGFTFSSYAMSWVRQTPEKRLEWVTSISSGGTTYYPDSVKGRFTISRDNARNILFLQMSSLRSEDTAMYYCARGPHWYLDVWGAGTSVTVSSSTKG

SEQ ID NO: 515 - protein, 117 aa, Artificial Sequence
  an artificially synthesized sequence
DILMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHLPLTFGAGTKLELKRTVAA

SEQ ID NO: 516 - protein, 117 aa, Artificial Sequence
  an artificially synthesized sequence
QSLEESGGGLVTPGTPLTLTCTVSGLSLSNSVMSWVRQAPGKGLEWIGFISIHDETNYATWAKGRFTISKTSSTTVDLKMTSPTTDDTATYFCARDGDSHGFYFGLWGPGTLVTVSS

SEQ ID NO: 517 - protein, 111 aa, Artificial Sequence
  an artificially synthesized sequence
QVLTQTPSPVSAAVGGTVTINCQASQSVYNKNNLAWYQQKPGQPPKLLIYDASKLASGVPSRFKGGGSGTHFTLTISGVQCDDAATYYCQGTYYSSGWYNTFGGGTKVEIK

SEQ ID NO: 518 - protein, 323 aa, Artificial Sequence
  an artificially synthesized sequence
GQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPMCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPTVLDSDGSYFLYSKLSVPTSEWQRGDVFTCSVMHEALHNHYTQKSISRSPGK

SEQ ID NO: 519 - protein, 104 aa, Artificial Sequence
  an artificially synthesized sequence
RDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 520 - protein, 328 aa, Artificial Sequence
  an artificially synthesized sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 521 - protein, 107 aa, Artificial Sequence [sequence omitted]

SEQ ID NO: 522 - protein, 107 aa, Artificial Sequence
  an artificially synthesized sequence
RTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 523 - protein, 327 aa, Artificial Sequence
  an artificially synthesized sequence
GQPKAPSVFPLAPSSGDTPSSTVTLGCLVKGYLPEPVTVTWNSGTLTNGVRTFPSVRQSSGLYSLSSVVSVTSSSQPVTCNVAHPATNTKVDKTVAPSTCDKTHTCPPCPPPELRRGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPTVLDSDGSYFLYSKLSVPTSEWQRGDVFTCSVMHEALHNHYTQKSISRSPGK

SEQ ID NO: 524 - protein, 325 aa, Artificial Sequence
  an artificially synthesized sequence
GQPKAPSVFPLAPSSGDTPSSTVTLGCLVKGYLPEPVTVTWNSGTLTNGVRTFPSVRQSSGLYSLSSVVSVTSSSQPVTCNVAHPATNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 525 - protein, 104 aa, Artificial Sequence
  an artificially synthesized sequence
GDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 526 - protein, 126 aa, Artificial Sequence
  an artificially synthesized sequence
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 527 - protein, 116 aa, Artificial Sequence
  an artificially synthesized sequence
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSS

SEQ ID NO: 528 - protein, 107 aa, Artificial Sequence
  an artificially synthesized sequence
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVK

SEQ ID NO: 529 - protein, 104 aa, Artificial Sequence
  an artificially synthesized sequence
RDPVAPTVLIFPPAADQVATGTVTIVCVANKYFPDVTVTWEVDGTTQTTGIENSKTPQNSADSTYNLSSTLTLTSTQYNSHKEYTCKVTQGTTSVVQSFNRGDC

SEQ ID NO: 530 - protein, 910 aa, Artificial Sequence
  an artificially synthesized sequence
MTTLLLVFVTLRVIAAVISEEVPDHDNSLSVSIPQPSPLKVLLGSSLTIPCYFIDPMHPVTTAPSTAPLTPRIKWSRVSKEKEVVLLVATEGQVRVNSIYQDKVSLPNYPAIPSDATLEIQNLRSNDSGIYRCEVMHGIEDSEATLEVIVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQGGMDMCSAGWLADRSVRYPISKARPNCGGNLLGVRTVYLHANQTGYPDPSSRYDAICYTGEDFMDIPENFFGVGGEEDITVQTVTWPDVELPVPRNITEGEARGSVVLTAKPVLDVSPTAPQPEETFAPGVGATAFPGVENGTEEATRPRGFADEATLGPSSATAFTSADLVVQVTAAPGVAEVPGQPRLPGGVVFHYRPGSTRYSLTFEEAQQACMHTGAVIASPEQLQAAYEAGYEQCDAGWLQDQTVRYPIVSPRTPCVGDKDSSPGVRTYGVRPSSETYDVYCYVDKLEGEVFFATRLEQFTFQEARAFCAAQNATLASTGQLYAAWSQGLDKCYAGWLADGTLRYPIITPRPACGGDKPGVRTVYLYPNQTGLPDPLSKHHAFCFRGGGGSTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHYHVTQKSLSLSP

SEQ ID NO: 531 - protein, 910 aa, Artificial Sequence
  an artificially synthesized sequence
MTTLLLVLVALRVIAAAISGDVSDLDNALSVSIPQPSPVRALLGTSLTIPCYFIDPVHPVTTAPSTAPLTPRIKWSRISKDKEVVLLVANEGRVRINSAYQDKVSLPNYPAIPSDATLEIQSLRSNDSGIYRCEVMHGLEDSEATLEVVVKGVVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAASECRRLGARLATTGQLYLAWQAGMDMCSAGWLADRSVRYPISKARPNCGGNLLGVRTVYVHANQTGYPDPSSRYDAICYTGEDFMDIPENFFGVGGEEDITVQTVTWPDVELPVPRNITEGEARGSVVLTAKPVLDVSPTAPQPEETFAPGVGATAFPGVENGTEEATRPRGFADEATLGPSSATAFTSADLVVQVTAAPGVAEVPGQPRLPGGVVFHYRPGPTRYSLTFEEAQQACLRTGAAMASAEQLQAAYEAGYEQCDAGWLQDQTVRYPIVSPRTPCVGDKDSSPGVRTYGVRPPSETYDVYCYVDRLEGEVFFATRLEQFTFQEALEFCESHNATLASTGQLYAAWSRGLDRCYAGWLADGSLRYPIVTPRPACGGDKPGVRTVYLYPNQTGLPDPLSRHHAFCFRGGGGSTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHYHVTQKSLSLSP

SEQ ID NO: 532 - protein, 381 aa, Artificial Sequence
  an artificially synthesized sequence
MGWSCIILFLVATATGVHSTGEDFMDIPENFFGVGGEEDITVQTVTWPDVELPVPRNITEGEARGSVVLTAKPVLDVSPTAPQPEETFAPGVGATAFPGVENGTEEATRPRGFADEATLGPSSATAFTSADLVVQVTAAPGVAEVPGQPRLPGGGGGSTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHYHVTQKSLSLSP

SEQ ID NO: 533 - protein, 690 aa, Artificial Sequence
  an artificially synthesized sequence
MTTLLLVLVALRVIAAAISGDVSDLDNALSVSIPQPSPVRALLGTSLTIPCYFIDPVHPVTTAPSTAPLTPRIKWSRISKDKEVVLLVANEGRVRINSAYQDKVSLPNYPAIPSDATLEIQSLRSNDSGIYRCEVMHGLEDSEATLEVVVKGVVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAASECRRLGARLATTGQLYLAWQAGMDMCSAGWLADRSVRYPISKARPNCGGNLLGVRTVYVHANQTGYPDPSSRYDAICYTGEDFMDIPENFFGVGGEEDITVQTVTWPDVELPVPRNITEGEARGSVVLTAKPVLDVSPTAPQPEETFAPGVGATAFPGVENGTEEATRPRGFADEATLGPSSATAFTSADLVVQVTAAPGVAEVPGQPRLPGGVVFHYRPGPTRYSLTFEEAQQACLRTGAAMASAEQLQAAYEAGYEQCDAGWLQDQTVRYPIVSPRTPCVGDKDSSPGVRTYGVRPPSETYDVYCYVDRLEGEVFFATRLEQFTFQEALEFCESHNATLASTGQLYAAWSRGLDRCYAGWLADGSLRYPIVTPRPACGGDKPGVRTVYLYPNQTGLPDPLSRHHAFCFRDYKDDDDK

SEQ ID NO: 534 - protein, 683 aa, Homo sapiens
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRDYKDDDDK

SEQ ID NO: 535 - protein, 740 aa, Artificial Sequence
  an artificially synthesized sequence
MTTLLLVLVALRVIAALNDIFEAQKIEWHEGGGGSGGGGSGGGGSAISGDVSDLDNALSVSIPQPSPVRALLGTSLTIPCYFIDPVHPVTTAPSTAPLTPRIKWSRISKDKEVVLLVANEGRVRINSAYQDKVSLPNYPAIPSDATLEIQSLRSNDSGIYRCEVMHGLEDSEATLEVVVKGVVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAASECRRLGARLATTGQLYLAWQAGMDMCSAGWLADRSVRYPISKARPNCGGNLLGVRTVYVHANQTGYPDPSSRYDAICYTGEDFMDIPENFFGVGGEEDITVQTVTWPDVELPVPRNITEGEARGSVVLTAKPVLDVSPTAPQPEETFAPGVGATAFPGVENGTEEATRPRGFADEATLGPSSATAFTSADLVVQVTAAPGVAEVPGQPRLPGGVVFHYRPGPTRYSLTFEEAQQACLRTGAAMASAEQLQAAYEAGYEQCDAGWLQDQTVRYPIVSPRTPCVGDKDSSPGVRTYGVRPPSETYDVYCYVDRLEGEVFFATRLEQFTFQEALEFCESHNATLASTGQLYAAWSRGLDRCYAGWLADGSLRYPIVTPRPACGGDKPGVRTVYLYPNQTGLPDPLSRHHAFCFRGGGGSDYKDDDDKDYKDDDDKDYKDDDDK

SEQ ID NO: 536 - protein, 17 aa, Artificial Sequence
  an artificially synthesized sequence
GPPGPQGLAGQRGIVGL

SEQ ID NO: 537 - protein, 10 aa, Artificial Sequence
  an artificially synthesized sequence
TVSSASTKGP

SEQ ID NO: 538 - protein, 11 aa, Artificial Sequence
  an artificially synthesized sequence
VEIKRTVAAPS

SEQ ID NO: 539 - protein, 347 aa, Escherichia coli; identical to SEQ ID NO: 201

SEQ ID NO: 540 - protein, 4 aa, Artificial Sequence
  an artificially synthesized sequence
KERE

SEQ ID NO: 541 - protein, 4 aa, Artificial Sequence
  an artificially synthesized sequence
KQRE

SEQ ID NO: 542 - protein, 4 aa, Artificial Sequence
  an artificially synthesized sequence
GLEW

SEQ ID NO: 543 - protein, 138 aa, Artificial Sequence
  an artificially synthesized sequence
QVQLVESGGGSGQSGGSLTLSCAASGFDLDYYAVGWFRQAPGKEREGVACTSVSGANISYVDSVKGRFTIYRDNVKKTVELSLDSLKPEDTAVYYCATTWGIHWCPLIASEYRRWGRGTQVTVSSGGGGSHHHHHHHH

SEQ ID NO: 544 - protein, 146 aa, Artificial Sequence
  an artificially synthesized sequence
QVQLVESGGGSGQSGGSLTLSCAASGFDLDYYAVGWFRQAPGKEREGVACTSVSGANISYVDSVKGRFTIYRDNVKKTVELSLDSLKPEDTAVYYCATTWGIHWCPLIASEYRRWGRGTQVTVSSGGGGSHHHHHHHHDYKDDDDK

SEQ ID NO: 545 - protein, 141 aa, Artificial Sequence
  an artificially synthesized sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSGGGGSHHHHHHHH

SEQ ID NO: 546 - protein, 142 aa, Artificial Sequence
  an artificially synthesized sequence
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSSHHHHHHDYKDDDDK

SEQ ID NO: 547 - protein, 444 aa, Artificial Sequence
  an artificially synthesized sequence
EVKLMESGGGLVKPGGSLKLSCAASGFTFSSYAMSWVRQTPEKRLEWVTSISSGGTTYYPDSVKGRFTISRDNARNILFLQMSSLRSEDTAMYYCARGPHWYLDVWGAGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 548 - protein, 445 aa, Artificial Sequence
  an artificially synthesized sequence
QSLEESGGGLVTPGTPLTLTCTVSGLSLSNSVMSWVRQAPGKGLEWIGFISIHDETNYATWAKGRFTISKTSSTTVDLKMTSPTTDDTATYFCARDGDSHGFYFGLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 549 - protein, 438 aa, Artificial Sequence
  an artificially synthesized sequence
QSVEESGGRLVTPGTPLTLTCTVSGVDLSNYAIHWVRQAPGKGLEWIGMIRSNGMIYYATWAKGRFTTSKTSSTTVDLKMTSPTTEDTATYFCARLWNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 550 - protein, 438 aa, Artificial Sequence
  an artificially synthesized sequence
QSVEESGGRLVTPGTPLTLTCTVSGVDLSNYAIHWVRQAPGKGLEWIGMIRSNGMRYYGTWAKGRFTTSKTSSTTVDLKMTSPTTEDTATYFCARLWNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 551 - protein, 438 aa, Artificial Sequence
  an artificially synthesized sequence
QSVEESGGDLVTPGTPLTLTCTVDGVDLSNYAIHWVRQAPGKGLEWIGMIRSNGMRYYGTWAKGRFTTSKTSSTTVDLKMTSPTTEDTATYFCARLWNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 552 - protein, 444 aa, Artificial Sequence
  an artificially synthesized sequence
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 553 - protein, 438 aa, Artificial Sequence
  an artificially synthesized sequence
QSVEESGGRLVTPGTPLTLTCTVSGVDLSNYAIHWVRQAPGKGLEWIGMIRSNGMRYYGTWAKGRFTTSKTSSTTVDLKMTSPTTEDTATYFCARLWNIWGPGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 554 - protein, 438 aa, Artificial Sequence
  an artificially synthesized sequence
QSVEESGGRLVTPGTPLTLTCTVSGVDLSNYAIHWVRQAPGKGLEWIGMIRSNGMRYYGTWAKGRFTTSKTSSTTVDLKMTSPTTEDTATYFCARLWNIWGPGTLVTVSSASTEGPSVFPLAPSSKSTSGGTAALGCLVEDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 555 - protein, 219 aa, Artificial Sequence
  an artificially synthesized sequence
DILMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHLPLTFGAGTKLELKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 556 - protein, 219 aa, Artificial Sequence
  an artificially synthesized sequence
AQVLTQTPSPVSAAVGGTVTINCQASQSVYNKNNLAWYQQKPGQPPKLLIYDASKLASGVPSRFKGGGSGTHFTLTISGVQCDDAATYYCQGTYYSSGWYNTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 557 - protein, 216 aa, Artificial Sequence
  an artificially synthesized sequence
AQVLTQTPSSTSVAVGGTVTINCQSSPSVYSNLLAWYQQKPGQPPKLLIYSASALQSGVPPRFSGSGSGTQFTLTISGVQCADAATYYCAGVYSNNIYTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 558 - protein, 216 aa, Artificial Sequence
  an artificially synthesized sequence
AQVLTQTPSSTSVAVGGTVTINCQSSPSVYLNLLAWYQQKPGQPPKLLIYSASFLQSGVPPRFSGSGSGTQFTLTISGVQCADAATYYCAGVYSNNIYTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 559 - protein, 216 aa, Artificial Sequence
  an artificially synthesized sequence
AQVLTQTPSSTSVAVGGTVTINCQSSPSVYLNLLAWYQQKPGQPPKLLIYSASALQSGVPPRFSGSGSGTQFTLTISGVQCADAATYYCAGVYSNNIYTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 560 - protein, 216 aa, Artificial Sequence
  an artificially synthesized sequence
AQVLTQTPSSTSVAVGGTVTINCQSSPSVYLNLLAWYQQKPGQPPKLLIYSASFLQSDVPDRFSGSGDGDQFDLDIDGVQCADAATYYCAGVYSNNIYTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 561 - protein, 216 aa, Artificial Sequence
  an artificially synthesized sequence
AQVLDQTPSSTSVAVGGTVTINCQSSPSVYLNLLAWYQQKPGQPPKLLIYSASFLQSDVPDRFSGSGDGDQFDLDIDGVQCADAATYYCAGVYSNNIYTFGGGTKVEIKRTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 562 - protein, 214 aa, Artificial Sequence
  an artificially synthesized sequence
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 563 - protein, 216 aa, Artificial Sequence
  an artificially synthesized sequence
AQVLTQTPSSTSVAVGGTVTINCQSSPSVYLNLLAWYQQKPGQPPKLLIYSASFLQSGVPPRFSGSGSGTQFTLTISGVQCADAATYYCAGVYSNNIYTFGGGTKVEIKETVAAPSVFIFPPSDEQLKSGTASVVCLLNNFYPREAEVQWKVDNALQSGNSQESVTEQDSKDCTYSLSSTLTLSKADYEKHKVYACEVTHQGLSSPVTKSFNRGEC

SEQ ID NO: 564 - protein, 216 aa, Artificial Sequence; identical to SEQ ID NO: 563
  an artificially synthesized sequence

SEQ ID NO: 565 - protein, 216 aa, Artificial Sequence
  an artificially synthesized sequence
AQVLTQTPSSTSVAVGGTVTINCQSSPSVYLNLLAWYQQKPGQPPKLLIYSASFLQSGVPPRFSGSGSGTQFTLTISGVQCADAATYYCAGVYSNNIYTFGGGTKVEIKRTVAAPSVFIFPPSDEQLKSGTASVVCLLNNFYPREAEVQWKVDNALQSGNSQESVTEQDSEDCTYSLSSTLTLSKADYEKHKVYACEVTHQGLSSPVTKSFNRGEC

SEQ ID NO: 566 - protein, 216 aa, Artificial Sequence
  an artificially synthesized sequence
AQVLTQTPSSTSVAVGGTVTINCQSSPSVYLNLLAWYQQKPGQPPKLLIYSASFLQSGVPPRFSGSGSGTQFTLTISGVQCADAATYYCAGVYSNNIYTFGGGTKVEIKETVAAPSVFIFPPSDEQLKSGTASVVCLLNNFYPREAEVQWKVDNALQSGNSQESVTEQDSEDCTYSLSSTLTLSKADYEKHKVYACEVTHQGLSSPVTKSFNRGEC

---

The invention claimed is:
1. A polypeptide comprising an aggrecan-binding domain linked by a peptide linker to a carrying moiety, wherein
  (i) the aggrecan-binding domain has a molecular weight of 120 kDa or smaller and comprises the complementarity determining regions of:
    (a) a VH sequence of SEQ ID NO: 512 and VL sequence of SEQ ID NO: 513,
    (b) a VH sequence of SEQ ID NO: 514 and VL sequence of SEQ ID NO: 515,
    (c) a VH sequence of SEQ ID NO: 516 and VL sequence of SEQ ID NO: 517, or
    (d) a VH sequence of SEQ ID NO: 510 and VL sequence of SEQ ID NO: 511,
  (ii) the peptide linker comprises a protease cleavage site, and

(iii) the carrying moiety comprises an antibody constant region.

2. A pharmaceutical composition comprising the polypeptide according to claim 1.

3. The polypeptide according to claim 1, wherein the aggrecan-binding domain comprises:
(a) a VH sequence of SEQ ID NO: 512 and VL sequence of SEQ ID NO: 513,
(b) a VH sequence of SEQ ID NO: 514 and VL sequence of SEQ ID NO: 515, or
(c) a VH sequence of SEQ ID NO: 516 and VL sequence of SEQ ID NO: 517.

4. The polypeptide according to claim 1, wherein the aggrecan-binding domain comprises a VH sequence of SEQ ID NO: 510 and VL sequence of SEQ ID NO: 511.

5. An anti-Aggrecan antibody or antigen-binding domain thereof comprising the complementarity determining regions of:
(a) a VH sequence of SEQ ID NO: 512 and VL sequence of SEQ ID NO: 513,
(b) a VH sequence of SEQ ID NO: 514 and VL sequence of SEQ ID NO: 515,
(c) a VH sequence of SEQ ID NO: 516 and VL sequence of SEQ ID NO: 517, or
(d) a VH sequence of SEQ ID NO: 510 and VL sequence of SEQ ID NO: 511.

6. The antibody or antigen-binding domain thereof according to claim 5, wherein the antigen binding domain comprises:
(a) a VH sequence of SEQ ID NO: 512 and VL sequence of SEQ ID NO: 513,
(b) a VH sequence of SEQ ID NO: 514 and VL sequence of SEQ ID NO: 515,
(c) a VH sequence of SEQ ID NO: 516 and VL sequence of SEQ ID NO: 517, or
(d) a VH sequence of SEQ ID NO: 510 and VL sequence of SEQ ID NO: 511.

7. The antibody or antigen-binding domain thereof according to claim 5, wherein the antigen binding domain comprises the complementarity determining regions of a VH sequence of SEQ ID NO: 510 and VL sequence of SEQ ID NO: 511.

8. The antibody or antigen-binding domain thereof according to claim 5, wherein the antigen binding domain comprises a VH sequence of SEQ ID NO: 510 and VL sequence of SEQ ID NO: 511.

9. The antibody or antigen-binding domain thereof according to claim 5, wherein the molecular weight of the antibody is 120 kDa or less.

10. A pharmaceutical composition comprising the antibody or antigen-binding domain thereof according to claim 5.

11. A polynucleotide encoding the polypeptide according to claim 1.

12. A vector comprising the polynucleotide according to claim 11.

13. A host cell comprising the polynucleotide according to claim 11, or the vector according to claim 12.

14. A method for producing a polypeptide, comprising the step of culturing the host cell according to claim 13.

15. A method of treating an aggrecan associated disease or disorder comprising administering to an individual in need thereof a therapeutically effective amount of the polypeptide according to claim 1, and wherein the treating is selected from the group consisting of: alleviating the symptoms of the disease, attenuating a direct or indirect pathological influence of the disease, reducing the rate of progression of the disease, alleviating a disease condition, and ameliorating or improving prognosis of the disease or condition.

16. A method of treating a disease or disorder in an individual comprising administering to the individual in need thereof a therapeutically effective amount of the polypeptide according to claim 1, wherein the disease or disorder is selected from the group consisting of osteoarthritis (OA), cartilage degradation in osteoarthritis (OA), traumatic arthritis, degenerative disc disease, temporomandibular joint arthrosis, and osteitis pubis, and wherein the treating is selected from the group consisting of: alleviating the symptoms of the disease, attenuating a direct or indirect pathological influence of the disease, reducing the rate of progression of the disease, alleviating a disease condition, and ameliorating or improving prognosis of the disease or condition.

17. A polynucleotide encoding the antibody or antigen-binding domain thereof according to claim 5.

18. A vector comprising the polynucleotide according to claim 17.

19. A host cell comprising the polynucleotide according to claim 17.

20. A method for producing an antibody or antigen-binding domain thereof, comprising the step of culturing the host cell according to claim 19.

21. A method of treating an aggrecan associated disease or disorder comprising administering to the individual in need thereof a therapeutically effective amount of the antibody or antigen-binding domain thereof according to claim 5, and wherein the treating is selected from the group consisting of: alleviating the symptoms of the disease, attenuating a direct or indirect pathological influence of the disease, reducing the rate of progression of the disease, alleviating a disease condition, and ameliorating or improving prognosis of the disease or condition.

22. A method of treating a disease or disorder comprising administering to the individual in need thereof a therapeutically effective amount of the antibody or antigen-binding domain thereof according to claim 5, wherein the disease or disorder is selected from the group consisting of osteoarthritis (OA), cartilage degradation in osteoarthritis (OA), traumatic arthritis, degenerative disc disease, temporomandibular joint arthrosis, and osteitis pubis, and wherein the treating is selected from the group consisting of: alleviating the symptoms of the disease, attenuating a direct or indirect pathological influence of the disease, reducing the rate of progression of the disease, alleviating a disease condition, and ameliorating or improving prognosis of the disease or condition.

23. The polypeptide according to claim 1, wherein the protease cleavage site is selected from the group consisting of ADAMTS4 cleavage site, ADAMTS5 cleavage site, and MMP-13 cleavage site.

24. A method for reducing cartilage degradation of an individual having osteoarthritis (OA) comprising administering to the individual a therapeutically effective amount of the polypeptide according to claim 1.

25. A method for reducing cartilage degradation of an individual having osteoarthritis (OA) comprising administering to the individual a therapeutically effective amount of the antibody or antigen-binding domain thereof according to claim 5.

26. The polypeptide according to claim 1, wherein the aggrecan-binding domain comprises:
(a) a VH comprising at least 85%, 90%, or 95% sequence identity to the sequence of SEQ ID NO: 512 and a VL comprising at least 85%, 90%, or 95% sequence identity to the sequence of SEQ ID NO: 513, (b) a VH comprising at least 85%, 90%, or 95% sequence identity to the sequence of SEQ ID NO: 514 and a VL comprising at least 85%, 90%, or 95% sequence identity to the sequence of SEQ ID NO: 515, (c) a VH comprising at least 85%, 90%, or 95% sequence identity to the sequence of SEQ ID NO: 516 and a VL comprising at least 85%, 90%, or 95% sequence identity to the sequence of SEQ ID NO: 517, or (d) a VH comprising at least 85%, 90%, or 95% sequence identity to the sequence of SEQ ID NO: 510 and a VL comprising at least 85%, 90%, or 95% sequence identity to the sequence of SEQ ID NO: 511.

27. The antibody or antigen-binding domain thereof according to claim 6, wherein the antigen binding domain comprises:

(a) a VH comprising at least 85%, 90%, or 95% sequence identity to the sequence of SEQ ID NO: 512 and a VL comprising at least 85%, 90%, or 95% sequence identity to the sequence of SEQ ID NO: 513, (b) a VH comprising at least 85%, 90%, or 95% sequence identity to the sequence of SEQ ID NO: 514 and a VL comprising at least 85%, 90%, or 95% sequence identity to the sequence of SEQ ID NO: 515, (c) a VH comprising at least 85%, 90%, or 95% sequence identity to the sequence of SEQ ID NO: 516 and a VL comprising at least 85%, 90%, or 95% sequence identity to the sequence of SEQ ID NO: 517, or (d) a VH comprising at least 85%, 90%, or 95% sequence identity to the sequence of SEQ ID NO: 510 and a VL comprising at least 85%, 90%, or 95% sequence identity to the sequence of SEQ ID NO: 511.

* * * * *